(12) United States Patent
Kley et al.

(10) Patent No.: US 12,410,225 B2
(45) Date of Patent: Sep. 9, 2025

(54) MODULATION OF DENDRITIC CELL LINEAGES

(71) Applicants: Orionis Biosciences, Inc., Waltham, MA (US); Orionis Biosciences BV, Ghent (BE); VIB VZW, Ghent (BE); Universiteit Gent, Ghent (BE)

(72) Inventors: Nikolai Kley, Waltham, MA (US); Jan Tavernier, Balegem (BE); Anje Cauwels, Merelbeke (BE); Lennart Zabeau, Zwijnaarde (BE); Erik Depla, Zwijnaarde (BE)

(73) Assignees: Orionis Biosciences, Inc, Waltham, MA (US); Orionis Biosciences BV, Ghent (BE); VIB VZW, Ghent (BE); Universiteit Gent, Ghent (BE)

( * ) Notice: Subject to any disclaimer, the term of this patent is extended or adjusted under 35 U.S.C. 154(b) by 1078 days.

(21) Appl. No.: 17/292,017

(22) PCT Filed: Nov. 7, 2019

(86) PCT No.: PCT/US2019/060291
§ 371 (c)(1),
(2) Date: May 7, 2021

(87) PCT Pub. No.: WO2020/097350
PCT Pub. Date: May 14, 2020

(65) Prior Publication Data
US 2022/0119472 A1    Apr. 21, 2022

Related U.S. Application Data

(60) Provisional application No. 62/757,643, filed on Nov. 8, 2018.

(51) Int. Cl.
| | | |
|---|---|---|
| C07K 14/56 | (2006.01) | |
| A61P 35/00 | (2006.01) | |
| C07K 14/565 | (2006.01) | |
| C07K 16/28 | (2006.01) | |
| A61K 38/00 | (2006.01) | |
| A61K 39/00 | (2006.01) | |

(52) U.S. Cl.
CPC ............. *C07K 14/56* (2013.01); *A61P 35/00* (2018.01); *C07K 14/565* (2013.01); *C07K 16/2815* (2013.01); *C07K 16/2818* (2013.01); *C07K 16/2827* (2013.01); *C07K 16/2851* (2013.01); *C07K 16/2896* (2013.01); *A61K 38/00* (2013.01); *A61K 2039/505* (2013.01); *C07K 2317/22* (2013.01); *C07K 2317/31* (2013.01); *C07K 2317/569* (2013.01); *C07K 2317/71* (2013.01); *C07K 2317/73* (2013.01); *C07K 2317/76* (2013.01); *C07K 2319/30* (2013.01); *C07K 2319/33* (2013.01); *C07K 2319/74* (2013.01)

(58) Field of Classification Search
None
See application file for complete search history.

(56) References Cited

U.S. PATENT DOCUMENTS

| | | |
|---|---|---|
| 3,536,809 A | 10/1970 | Applezweig |
| 3,598,123 A | 8/1971 | Zaffaroni |
| 3,845,770 A | 11/1974 | Theeuwes et al. |
| 3,916,899 A | 11/1975 | Theeuwes et al. |
| 4,008,719 A | 2/1977 | Theeuwes et al. |
| 4,537,776 A | 8/1985 | Cooper |
| 5,059,595 A | 10/1991 | Le Grazie |
| 5,073,543 A | 12/1991 | Marshall et al. |
| 5,120,548 A | 6/1992 | McClelland et al. |
| 5,354,556 A | 10/1994 | Sparks et al. |
| 5,475,096 A | 12/1995 | Gold et al. |
| 5,591,767 A | 1/1997 | Mohr et al. |
| 5,639,476 A | 6/1997 | Oshlack et al. |
| 5,674,533 A | 10/1997 | Santus et al. |
| 5,716,946 A | 2/1998 | DeLuca et al. |
| 5,733,556 A | 3/1998 | Schrier et al. |
| 5,831,012 A | 11/1998 | Nilsson et al. |
| 5,914,254 A | 6/1999 | Mascarenhas et al. |
| 6,004,746 A | 12/1999 | Brent et al. |
| 6,433,157 B1 | 8/2002 | Shanafelt et al. |
| 6,653,104 B2 | 11/2003 | Goldenberg |
| 6,794,144 B1 | 9/2004 | Saksela et al. |

(Continued)

FOREIGN PATENT DOCUMENTS

| | | |
|---|---|---|
| RU | 2011127226 A | 1/2013 |
| WO | WO 91/02754 A1 | 3/1991 |

(Continued)

OTHER PUBLICATIONS

Cauwels et al (Cancer Research, Jan. 15, 2018, 78:463-474).*
Caminschi, et al., "The dendritic cell subtype-restricted C-type lectin Clec9A is a target for vaccine enhancement," Blood, vol. 112, No. 8, pp. 3264-3273, 2008.
Chen, et al., "Dendritic cell targeted vaccines: Recent progresses and challenges," Human Vaccines & Immunotherapeutics, vol. 12, No. 3, pp. 612-622, 2015.

(Continued)

*Primary Examiner* — Laura B Goddard
(74) *Attorney, Agent, or Firm* — Morgan, Lewis & Bockius LLP

(57) ABSTRACT

The present invention relates, in part, to agents, chimeric proteins and chimeric protein complexes that bind a plasmacytoid dendritic cell (pDC), e.g. Clec4C and their use as diagnostic and therapeutic agents. The present invention further relates to pharmaceutical compositions comprising the pDC, e.g. Clec4C, binding agents, chimeric proteins, or chimeric protein complexes and their use in the treatment of various diseases, including autoimmune diseases.

17 Claims, 39 Drawing Sheets
Specification includes a Sequence Listing.

(56) References Cited

U.S. PATENT DOCUMENTS

| | | |
|---|---|---|
| 6,818,418 B1 | 11/2004 | Lipovsek et al. |
| 6,994,982 B1 | 2/2006 | Watt et al. |
| 7,166,697 B1 | 1/2007 | Galanis et al. |
| 7,186,524 B2 | 3/2007 | Kolmar et al. |
| 7,250,297 B1 | 7/2007 | Beste et al. |
| 7,417,130 B2 | 8/2008 | Stumpp et al. |
| 7,803,907 B2 | 9/2010 | Stemmer et al. |
| 7,838,629 B2 | 11/2010 | Fiedler et al. |
| 7,993,636 B2 | 8/2011 | Mayumi et al. |
| 8,008,449 B2 | 8/2011 | Korman et al. |
| 8,217,149 B2 | 7/2012 | Irving et al. |
| 8,354,509 B2 | 1/2013 | Carven et al. |
| 8,580,266 B2 | 11/2013 | Sancho-Madrid et al. |
| 8,609,089 B2 | 12/2013 | Langermann et al. |
| 8,779,108 B2 | 7/2014 | Queva et al. |
| 8,907,053 B2 | 12/2014 | Sasikumar et al. |
| 8,907,065 B2 | 12/2014 | Hermans et al. |
| 8,980,267 B2 | 3/2015 | Grewal et al. |
| 9,067,991 B2 | 6/2015 | Beirnaert |
| 9,139,634 B2 | 9/2015 | Morrison et al. |
| 9,371,389 B2 | 6/2016 | Sakamoto et al. |
| 9,492,562 B2 | 11/2016 | Tavernier et al. |
| 9,534,056 B2 | 1/2017 | Grewal et al. |
| 9,732,135 B2 | 8/2017 | Tavernier et al. |
| 9,878,014 B2 | 1/2018 | Tavernier et al. |
| 9,914,759 B2 | 3/2018 | Tavernier et al. |
| 9,932,409 B2 | 4/2018 | Tavernier et al. |
| 10,034,919 B2 | 7/2018 | Tavernier et al. |
| 10,035,835 B2 | 7/2018 | Tavernier et al. |
| 10,072,059 B2 | 9/2018 | Tavernier et al. |
| 10,407,480 B2 | 9/2019 | Tavernier et al. |
| 10,640,542 B2 | 5/2020 | Tavernier et al. |
| 10,787,493 B2 | 9/2020 | Tavernier et al. |
| 10,906,985 B2 | 2/2021 | Kley et al. |
| 10,946,070 B2 | 3/2021 | Tavernier et al. |
| 10,947,288 B2 | 3/2021 | Tavernier et al. |
| 10,988,538 B2 | 4/2021 | Kley et al. |
| 11,001,631 B2 | 5/2021 | Tavernier et al. |
| 11,084,859 B2 | 8/2021 | Kley et al. |
| 11,236,141 B2 | 2/2022 | Kley et al. |
| 11,236,166 B2 | 2/2022 | Kley et al. |
| 11,246,911 B2 | 2/2022 | Tavernier et al. |
| 11,248,057 B2 | 2/2022 | Tavernier et al. |
| 2002/0004525 A1 | 1/2002 | Colover |
| 2002/0022608 A1 | 2/2002 | Duncan et al. |
| 2002/0025304 A1 | 2/2002 | Croze et al. |
| 2004/0023334 A1 | 2/2004 | Prior |
| 2004/0132094 A1 | 7/2004 | Etzerodt et al. |
| 2004/0146938 A1 | 7/2004 | Nguyen et al. |
| 2004/0157209 A1 | 8/2004 | Yilmaz et al. |
| 2004/0209243 A1 | 10/2004 | Nixon et al. |
| 2008/0025980 A1 | 1/2008 | Hardy et al. |
| 2009/0202527 A1 | 8/2009 | Panzara et al. |
| 2010/0003253 A1 | 1/2010 | Laeremans et al. |
| 2010/0028330 A1 | 2/2010 | Collions et al. |
| 2010/0087630 A1 | 4/2010 | Oelert et al. |
| 2010/0119446 A1 | 5/2010 | Grabulovski et al. |
| 2010/0172868 A1 | 7/2010 | Morrison et al. |
| 2010/0239633 A1 | 9/2010 | Strome et al. |
| 2010/0297076 A1 | 11/2010 | Morrison et al. |
| 2011/0020273 A1 | 1/2011 | Chang et al. |
| 2011/0081341 A1 | 4/2011 | Honjo et al. |
| 2011/0104112 A1 | 5/2011 | Morrison et al. |
| 2011/0224407 A1 | 9/2011 | Langer et al. |
| 2011/0262348 A1 | 10/2011 | Movahedi et al. |
| 2011/0271358 A1 | 11/2011 | Freeman et al. |
| 2011/0274658 A1 | 11/2011 | Silver et al. |
| 2011/0318373 A1 | 12/2011 | Sasikumar et al. |
| 2012/0039906 A1 | 2/2012 | Olive |
| 2012/0114649 A1 | 5/2012 | Langermann et al. |
| 2012/0244112 A1 | 9/2012 | Ast et al. |
| 2013/0034559 A1 | 2/2013 | Queva et al. |
| 2013/0058962 A1 | 3/2013 | Shoemaker et al. |
| 2013/0183298 A1 | 7/2013 | Le et al. |
| 2013/0230517 A1 | 9/2013 | Grewal et al. |
| 2013/0245236 A1 | 9/2013 | Kroczek |
| 2013/0309250 A1 | 11/2013 | Cogswell et al. |
| 2014/0044738 A1 | 2/2014 | Langermann et al. |
| 2014/0271462 A1 | 9/2014 | Ho et al. |
| 2014/0328865 A1 | 11/2014 | Sancho-Madrid et al. |
| 2014/0348789 A1 | 11/2014 | Tavernier et al. |
| 2014/0356353 A1 | 12/2014 | Queva et al. |
| 2015/0139951 A1 | 5/2015 | Grewal et al. |
| 2015/0265721 A1 | 9/2015 | Lahoud et al. |
| 2015/0313965 A1 | 11/2015 | Pogue et al. |
| 2016/0075769 A1 | 3/2016 | Verheesen et al. |
| 2016/0145325 A1 | 5/2016 | Verheesen et al. |
| 2017/0016042 A1 | 1/2017 | Schellenberger et al. |
| 2017/0029506 A1 | 2/2017 | Van Der Vliet et al. |
| 2017/0327576 A1 | 11/2017 | Barden et al. |
| 2018/0186894 A1 | 7/2018 | Tavernier et al. |
| 2018/0333465 A1 | 11/2018 | Tavernier et al. |
| 2018/0334488 A1 | 11/2018 | Tavernier et al. |
| 2018/0334489 A1 | 11/2018 | Tavernier et al. |
| 2019/0010119 A1 | 1/2019 | Tavernier et al. |
| 2019/0071500 A1 | 3/2019 | Kley et al. |
| 2019/0092871 A1 | 3/2019 | Tavernier et al. |
| 2019/0144553 A1 | 5/2019 | Kley et al. |
| 2019/0194284 A1 | 6/2019 | Kley et al. |
| 2019/0202934 A1 | 7/2019 | Tavernier et al. |
| 2019/0351021 A1 | 11/2019 | Tavernier et al. |
| 2019/0352406 A1 | 11/2019 | Tavernier et al. |
| 2019/0367604 A1 | 12/2019 | Kley et al. |
| 2020/0071414 A1 | 3/2020 | Kley et al. |
| 2020/0087411 A1 | 3/2020 | Kley et al. |
| 2020/0231674 A1 | 7/2020 | Kley et al. |
| 2020/0255545 A1 | 8/2020 | Tavernier et al. |
| 2020/0262884 A1 | 8/2020 | Tavernier et al. |

FOREIGN PATENT DOCUMENTS

| | | |
|---|---|---|
| WO | WO 94/000491 | 1/1994 |
| WO | WO 94/04678 A1 | 3/1994 |
| WO | WO 96/34103 A1 | 10/1996 |
| WO | WO 97/10338 A1 | 3/1997 |
| WO | WO 99/37681 A2 | 7/1999 |
| WO | WO 00/43507 A1 | 7/2000 |
| WO | WO 01/014556 A1 | 3/2001 |
| WO | WO 01/90190 A2 | 11/2001 |
| WO | WO 02/085945 A2 | 10/2002 |
| WO | WO 03/025020 A1 | 3/2003 |
| WO | WO 2003/033720 A1 | 4/2003 |
| WO | WO 03/035694 A2 | 5/2003 |
| WO | WO 2004/041862 A2 | 5/2004 |
| WO | WO 2006/053883 A1 | 5/2006 |
| WO | WO 2006/115800 A2 | 11/2006 |
| WO | WO 2006/121168 A1 | 11/2006 |
| WO | WO 2007/005874 A2 | 1/2007 |
| WO | WO 2008/014612 A1 | 2/2008 |
| WO | WO 2008/07 1447 A2 | 6/2008 |
| WO | WO 2009/003145 A1 | 12/2008 |
| WO | WO 2009/013484 A1 | 1/2009 |
| WO | WO 2009/039409 A1 | 3/2009 |
| WO | WO2009053368 A1 | 4/2009 |
| WO | WO 2009/065561 A2 | 5/2009 |
| WO | WO 2009/089149 A1 | 7/2009 |
| WO | WO 2009/101611 A1 | 8/2009 |
| WO | WO 2009/114335 A2 | 9/2009 |
| WO | WO 2010/027827 A2 | 3/2010 |
| WO | WO 2010/030671 A1 | 3/2010 |
| WO | WO 2010/036918 A2 | 4/2010 |
| WO | WO 2010/036959 A2 | 4/2010 |
| WO | WO 2010/066740 A1 | 6/2010 |
| WO | WO 2010/077634 A1 | 7/2010 |
| WO | WO 2011/020783 A2 | 2/2011 |
| WO | WO 2011/029870 A1 | 3/2011 |
| WO | WO 2011/066342 A2 | 6/2011 |
| WO | WO 2011/066389 A1 | 6/2011 |
| WO | WO 2012/145493 A1 | 10/2012 |
| WO | WO 2012/170072 A1 | 12/2012 |
| WO | WO2013/010779 A1 | 1/2013 |
| WO | WO 2013/053008 A2 | 4/2013 |
| WO | WO 2013/059885 A2 | 5/2013 |
| WO | WO 2013/107791 A1 | 7/2013 |

(56) References Cited

FOREIGN PATENT DOCUMENTS

| WO | WO 2013/134138 A1 | 9/2013 | | |
|---|---|---|---|---|
| WO | WO 2013/163689 A1 | 11/2013 | | |
| WO | WO 2014/093396 A1 | 6/2014 | | |
| WO | WO 2015/007520 A1 | 1/2015 | | |
| WO | WO 2015/007536 A1 | 1/2015 | | |
| WO | WO 2015/007542 A1 | 1/2015 | | |
| WO | WO 2015/007903 A1 | 1/2015 | | |
| WO | WO 2015/018528 A1 | 2/2015 | | |
| WO | WO 2015/112900 A1 | 7/2015 | | |
| WO | WO 2016/022630 A1 | 2/2016 | | |
| WO | WO 2016/025385 A1 | 2/2016 | | |
| WO | WO 2016/061142 A1 | 4/2016 | | |
| WO | WO 2016/062722 A1 | 4/2016 | | |
| WO | WO 2016/113555 A1 | 7/2016 | | |
| WO | WO 2016/113557 A1 | 7/2016 | | |
| WO | WO 2016/187459 A1 | 11/2016 | | |
| WO | WO 2017/077382 A1 | 5/2017 | | |
| WO | WO 2017/134301 A1 | 8/2017 | | |
| WO | WO 2017/134302 A2 | 8/2017 | | |
| WO | WO 2017/134306 A1 | 8/2017 | | |
| WO | WO-2017134305 A1 * | 8/2017 | ............. | A61K 38/00 |
| WO | WO 2017/153402 A1 | 9/2017 | | |
| WO | WO 2017/194782 A2 | 11/2017 | | |
| WO | WO 2017/194783 A1 | 11/2017 | | |
| WO | WO 2018/077893 A1 | 5/2018 | | |
| WO | WO 2018/141964 A1 | 8/2018 | | |
| WO | WO 2018/144999 A1 | 8/2018 | | |
| WO | WO 2008/124086 A2 | 10/2018 | | |
| WO | WO 2018/185284 A1 | 10/2018 | | |
| WO | WO 2019/032661 A1 | 2/2019 | | |
| WO | WO 2019/032662 A1 | 2/2019 | | |
| WO | WO 2019/032663 A1 | 2/2019 | | |
| WO | WO 2019/148089 A1 | 8/2019 | | |
| WO | WO 2019/152979 A1 | 8/2019 | | |
| WO | WO-2019191519 A1 * | 10/2019 | ............. | A61K 38/00 |
| WO | WO 2020/033646 A1 | 2/2020 | | |
| WO | WO 2021/062184 A1 | 4/2021 | | |

OTHER PUBLICATIONS

Dzionek, et al., "BDCA-2, a Novel Plasmacytoid Dendritic Cell-specific Type II C-type Lectin, Mediates Antigen Capture and is a Potent Inhibitor of Interferon $\alpha/\beta$ Induction," Journal of Experimental Medicine, vol. 194, No. 12, pp. 1823-1834, 2001.
Fatima, et al., "Immunoglobin heavy chain variable region, partial [Lama glama]," National Institute of Biotechnology Information, 2 pages, May 5, 2014.
International Search Report & Written Opinion, PCT Application No. PCT/US2019/060291, dated Mar. 13, 2020, 23 pages.
McLean, et al., "Modified *Homo sapiens* anti-Pseudomonas aeruginosa IgG1 O6as heavy chain [synthetic construct]," National Institute of Biotechnology Information, 2 pages, Aug. 27, 2007.
Moayeri, et al., "Immunoglobin heavy chain variable region, partial [Vicugna pacos]," National Institute of Biotechnology Information, 1 page, Sep. 13, 2015.
Tullett, et al., "Targeting CLEC9A delivers antigen to human CD141+ DC for CD4+ and CD8+ T cell recognition," JCI Insight, vol. 1, No. 7, pp. 1-12, 2016.
Biliouris, et al., "A pre-clinical quantitative model predicts the pharmacokinetics/pharmacodynamics of an anti-BDCA2 monoclonal antibody in humans," J. of Phamacokinetics and Pharmacodynamics, 2018, vol. 45, pp. 817-827.
Fournier, et al., "Improved in vitro and in vivo activity against CD303-expressing tergets of the chimeric 122A2 antibody selected for specific glycosylation patten," MABS, 2018, vol. 10, No. 4, pp. 651-663.
Pellerin, et al., "Anti-BDCA2 monoclonal antibody inhibits plasmacytoid dentritic cell activation through Fc-dependent and Fc-independent mechanisms," Research Article: EMBO Molecular Medicine,2015, vol. 7, No. 4, pp. 464-476.

Riboldi, et al., "Engagement of BDCA-2 blocks TRAIL-mediated cytotoxic activity of plasmacytoid dendritic cells," Immunobiology, 2009, vol. 214, pp. 868-876.
Acres, et al., "Fusokine Interleukin-2/Interleukin-18, a Novel Potent Innate and Adaptive Immune Stimulator with Decreased Toxicity," Cancer Res., vol. 65, No. 20, pp. 9536-9546, 2005.
Alegre, et al., A non-activating "humanized" anti-CD3 monoclonal antibody retains immunosuppressive properties in vivo, Jun. 1994, Transplantation, vol. 57, pp. 1537-1543. (Abstract).
An, et al., 2009 mAbs, vol. 1, 2009—Issue 6, pp. 572-579.
Atwell, et al., "Stable heterodimers from remodeling the domain interface of a homodimer using a phage display library," JMB, vol. 270, Issue 1, Jul. 4, 1997, pp. 26-35.
Baba, et al., "Identification of CCR6, the Specific Receptor for a Novel Lymphocyte-Directed CC Chemokine LARC," The Journal of Biological Chemistry, vol. 272, No. 23, pp. 14893-14898, 1997.
Barbara, et al., "Dissociation of TNF-$\alpha$ cytotoxic and proinflammatory activities by p55 receptor-and p75 receptor-selective TNF-$\alpha$ mutants," EMBO Journal, vol. 13, No. 4, pp. 843-850, 1994.
Bork, et al., "Go hunting in sequence databases but watch out for the traps." Trends in Genetics, vol. 12, pp. 125-427, 1996.
Bork, "Powers and Pitfalls in Sequence Analysis: The 70% Hurdle," Genome Research, vol. 10, pp. 398-400, 2000.
Borrok, et al., "An Fc-Silenced" IgG1 Format with Extended Half-Life Desingned for Improved Stability, J. of Pharm. Sci., 2017, vol. 106, pp. 1008-1017.
Boschert, et al., "Single chain TNF derivatives with individually mutated receptor binding sites reveal differential stoichiometry of ligand receptor complex formation for TNFR1 and TNER2," Cellular Signalling 22 (7):1088-1096, 2010.
Bremer, et al., "Superior activity of fusion protein scFvRit:sFasL over cotreatment with rituximab and Fas agonists," Cancer Res. 68: 597-604, 2008.
Camacho, et al., "Structure of an Interleukin-1$\beta$ Mutant With Reduced Bioactivity Shows Multiple Subtle Changes in Conformation That Affect Protein-Protein Recognition," Biochemistry, vol. 32, No. 34, pp. 8749-8757, 1993.
Cao & Suresh, "Bispecific MAb Aided Liposomal Drug Delivery," Journal of Drug Targeting, 2000, vol. 8, No. 4, pp. 257-266, DOI: 10.3109/10611860008997904 (Abstract).
Carmenate, et al., "Human IL-2 Mutein with Higher Antitumor Efficacy Than Wild Type IL-2," The Journal of Immunology, May 2013, vol. 190, pp. 6230-6238.
Chapman, "PEGylated antibodies and antibody fragments for improved therapy: a review," Advanced Drug Delivery Reviews, vol. 54, Issue 4, pp. 531-545 (2002).
Chen, et al., "Fusion Protein Linkers: Property, Design and Functionality," Adv Drug Deliv Rev., Oct. 15, 2013, vol. 65, No. 10, pp. 1357-1369. doi:10.1016/j.addr.2012.09.039.
Chichili, et al., "Linkers in the structural biology of protein-protein interactions," Protein Sci., 2013, vol. 22, pp. 153-167.
Choi, et al., "Systemic administration of a bispecific antibody targeting EGFRvIII successfully treats intracerebral glioma," PNAS, Jan. 2, 2013, vol. 110, No. 1, pp. 270-275.
Couch, et al., "Addressing Safety Liabilities of TfR Bispecific Antibodies That Cross the Blood-Brain Barrier," Sci. Transl. Med., May 1, 2013, vol. 5, Issue 183, pp. 183ra57. (.
Coulstock, et al., "Liver-Targeting of Interferon-Alpha with Tissue Specific Domain Antibodies," PLOS One, vol. 8, No. 2, pp. 1-11, 2013.
Crasto, et al., "LINKER: a program to generate linker sequences for fusion proteins," Protein Eng., 2000, vol. 13, No. 5, pp. 309-312.
De Bruyn, et al., "Antibody-Based Fusion Proteins to Target Death Receptors in Cancer," Cancer Letters, vol. 332, pp. 175-183, 2013.
Deffar, et al., "Nanobodies—The New Concept in Antibody Engineering," African Journal of Biotechnology, vol. 8, No. 12, pp. 2645-2652, 2009.
Dijkmans, et al., "Murine Interferon-$\gamma$ Interleukin-1 Fusion Proteins Used as Antigens for the Generation of Hybridomas Producing Monoclonal Anti-Interleukin-1 Antibodies," Cytokine, vol. 3, No. 2, pp. 134-140, 1991.
Dimitrov, "Engineered CH2 Domains (Nanoantibodies)," mAbs, Landes Bioscience, vol. 1, No. 1, pp. 26-28, 2009.

(56) References Cited

OTHER PUBLICATIONS

Frey, et al., "Antibody-Based Targeting of Interferon-Alpha to the Tumor Neovasculature: A Critical Evaluation," Integrative Biology, vol. 3, pp. 468-478, 2011.
Garcin, et al., "High Efficiency cell-specific targeting of cytokine activity," Nature Communications, vol. 5, No. 8, 9 pages, 2014.
Garlanda, et al., "The Interleukin-1 Family: Back to the Future," Immunity, 39 (6): pp. 1003-1018, Dec. 12, 2013.
Gennaro, Remington: The Science and Practice of Pharmacy—19th Ed., 1995, Chapters 83-95, 272 pages.
Gilliland, et al., "Antibody-directed cytotoxic agents: Use of monoclonal antibody to direct the action of toxin A chains to colorectal carcinoma cells," Proc. Nat'l Acad. Sci. USA, 1980, vol. 77, No. 8, pp. 4539-4543.
Groopman, et al.,"Chemotherapy-Induced Anemia in Adults: Incidence and Treatment," J. Natl Cancer Inst., 1999, vol. 91, No. 19, pp. 1616-1634.
Gunasekaran, et al., "Enhancing Antibody Fc Heterodimer Formation through Electrostatic Steering Effects," The Journal of Biological Chemistry, 2010, vol. 285, No. 25, pp. 19637-19646.
Hamid, et al. "Safety and Tumor Responses with Lambrolizumab (Anti-PD-1) in Melanoma," The New England Journal of Medicine, 2013, vol. 369, pp. 134-144.
Harris, et al., "Effect of pegylation on pharmaceuticals," Nat. Rev. Drug. Discov., 2003, vol. 2, pp. 214-221. Abstract.
Hezareh, et al., "Effector Function Activities of a Panel of Mutants of a Broadly Neutralizing Antibody against Human Immunodeficiency Virus Type1," J. Virol. m Dec. 2001, vol. 75, No. 24, pp. 12161-12168.
Holler, et al., "Two Adjacent Trimeric Fas Ligands are Required for Fas Signaling and Formation of a Death-Inducing Signaling Complex," Molecular and Cellular Biology, vol. 23, No. 4, pp. 1428-1440, 2003.
Huang, et al., "A Trimeric Anti-HER2/neu ScFv and Tumor Necrosis Factor-[alpha] Fusion Protein Induces HER2/Neu Signaling and Facilitates Repair of Injured Epithelia," The Journal of Pharmacology and Experimental Therapeutics, vol. 316, No. 3, pp. 983-991, 2006.
Idoyaga, et al., "Comparable T helper 1 (Th1) and CD8 T-cell immunity by targeting HIV gag p24 to CD8 dendritic cells within antibodies to Langerin, DEC205, and Clec9A," PNAS, vol. 108, No. 6, pp. 2384-2389, Jan. 24, 2011.
Idusogie, et al.,"Mapping of the C1q Binding Site on Rituxan, a Chimeric Antibody with a Human IgG1 Fc," J. Immunolm, 2000, vol. 164, No. 8, pp. 4178-4184.
International Search Report & Written Opinion, PCT Application No. PCT/EP2017/052544, dated Jun. 6, 2017, 16 pages.
International Search Report & Written Opinion, PCT Application No. PCT/US2018/045742, dated Dec. 6, 2018, 15 pages.
International Search Report & Written Opinion, PCT Application No. PCT/US19/15393, dated Jun. 6, 2019, 17 pages.
Kircheis, et al., "Biological activity of mutants of human tumour necrosis factor-alpha," Immunology, pp. 433-438, Jul. 1, 1992.
Krippner-Heidenreich, et al., "Single-Chain TNF, a TNF Derivative with Enhanced Stability and Antitumoral Activity," The Journal of Immunology, vol. 180, pp. 8176-8183, 2008.
Krolick, et al., "Selective killing of normal or neoplastic B cells by antibodies coupled to the A chain of ricin," Proc. Nat'l Acad. Sci. USA, vol. 77, No. 9, pp. 5419-5423, Sep. 1980.
Labrijn, et al., "Efficient generation of stable bispecific IgG1 by controlled Fab-arm exchange," PNAS, Mar. 26, 2013, vol. 110, No. 13, pp. 5145-5150.
Lahoud, et al., "Targeting Antigen to Mouse Dendritic Cells via Clec9A Induces Potent CD4 T Cell Responses Biased toward a Follicular Helper Phenotype," The Journal of Immunology, vol. 187, No. 2, pp. 842-850, Jul. 15, 2011.
Langer, "New Methods of Drug Delivery," Science, 1990, vol. 249, Issue 4976, pp. 1527-1533. Abstract.
Leaver-Fay, et al., "Computationally Designed Bispecific Antibodies using Negative State Repertoires", Structure, 2016, vol. 24, Issue 4, pp. 641-651.
Lo, et al., "High level expression and secretion of Fc-X fusion proteins in mammalian cells," Protein Engineering, 1998, vol. 11, No. 6, pp. 495-500.
Lo, et al., "Effector-attenuating Substitutions That Maintain Antibody Stability and Reduce Toxicity in Mice," The Journal of Biological Chemistry, ASBMB, 2017, vol. 292, No. 9, pp. 3900-3908.
Loetscher, et al., "Human Tumor Necrosis Factor α (TNFα) Mutants with Exclusive Specificity for 55-kDA or 75-kDa TNF Receptors," Journal of Biological Chemistry, American Society For Biochemistry and Molecular Biology, US, vol. 268, No. 35, pp. 26350-26357, 1993.
Masci, et al., "New and Modified Interferon alfas: Preclinical and Clinical Data," Current Oncology Reports, vol. 5, pp. 108-113, 2003.
Merchant, et al., "An efficient route to human bispecific IgG," Nature Biotechnology, 1998, vol. 16, pp. 677-681. Abstract.
Minn, "Interferons and the Immunogenic Effects of Cancer Therapy," Trends In Immunology, vol. 36, No. 11, pp. 725-737, Nov. 1, 2015.
Moore, et al., "A robust heterodimeric Fc platform engineered for efficient development of bispecific antibodies of multiple formats," Methods, 2019, vol. 154, pp. 38-50.
Ngo, et al., "Computational Complexity, Protein Structure Prediction, and the Levinthal Paradox.The Protein Folding Problem and Tertiary Structure Prediction," Edited by: Mertz et al., (Birkhauser, Boston), pp. 491-495, 1994.
Nicolaou, et al., "Calicheamicin θurn:x-wiley:05700833:media:ANIE199401831:tex2gif-stack-1: A Rationally Designed Molecule with Extremely Potent and Selective DNA Cleaving Properties and Apoptosis Inducing Activity," Angew. Chem. Intl. Ed. Engl., 1994, vol. 33, No. 2, pp. 183-186.
Pan, et al., "Mutation of the IFNAR-1 Receptor Binding Site of Human IFN-α2 Generates Type I IFN Competitive Antagonists," Biochemistry, vol. 47, pp. 12018-12027, 2008.
Patris, et al., "Nanoimmunoassay onto a screen printed electrode for HER2 breast cancer biomarker determination," Talanta, 2014, vol. 130, pp. 164-170, 2014.
Penafuerte, et al., "The Human Ortholog of Granulocyte Macrophage Colony-Stimulating Factor and Interleukin-2 fusion Protein Induces Potent Ex Vivo Natural Killer Cell Activation and Maturation," Cancer Res, vol. 69, No. 23, pp. 9020-9028, 2009.
Picco, et al., "Targeting DNGR-1 (CLEC9A) with antibody/MUC1 peptide conjugates as a vaccine for carcinomas," European Journal of Immunology, vol. 44, No. 7, pp. 1947-1955, Apr. 17, 2014.
Piehler, et al., "New Structural and Functional Aspects of the Type I Interferon-Receptor Interaction Revealed by Comprehensive Mutational Analysis of the Binding Interface," Journal of Biological Chemistry, 2000, vol. 275, No. 51, pp. 40425-40433.
Puskas, et al., "Development of an attenuated interleukin-2 fusion protein that can be activated by tumour-expressed proteases," Immunology, vol. 133, No. 2, pp. 206-220, Jun. 23, 2011.
Rafei, et al., "An Engineered GM-CSF-CCL2 Fusokine Is A Potent Inhibitor of CCR2-Driven Inflammation as Demonstrated in a Murine Model of Inflammatory Arthritis," The Journal of Immunology, vol. 183, pp. 1759-1766, 2009.
Rafei, et al., "A MCP1 Fusokine with CCR2-Specific Tumoricidal Activity," Molecular Cancer, vol. 10, No. 121, pp. 1-11, 2011.
Roisman, et al., "Structure of the Interferon-Receptor Complex Determined by Distant Constraints from Double Mutant Cycles and Flexible Docking," PNAS, vol. 98, No. 23, pp. 13231-13236, 2001.
Rovero, et al., "Insertion of the DNA for the 163-171 Peptide of IL 1 II Enables a DNA Vaccine Encoding p185[neu] to inhibit Mammary Carcinogenesis in Her-2/neu Transgenic BALB/c Mice," Gene Therapy, vol. 8, pp. 447-452, 2001.
Sancho, et al., "Identification of a dendritic cell receptor that couples sensing of necrosis to immunity," Nature, Nature Publishing Group, United Kingdom, vol. 453, No. 7240, pp. 899-903, Apr. 16, 2009.

(56) References Cited

OTHER PUBLICATIONS

Schlothauer, et al., "Novel human IgG1 and IgG4 Fc-engineered antibodies with completely abolished immune effector functions," Protein Engineering, Design and Selection, 2016, vol. 29, Issue 10, pp. 457-466.

Schutyser, et al., "The CC Chemokine CCL20 and its Receptor CCR6," Cytokine & Growth Factor Reviews, vol. 14, pp. 409-426, 2003.

Stahl, "Fusion Proteins for Half-Life Extension of Biologics as a Strategy to Make Biobetters," BioDrugs, 2015, vol. 29, pp. 215-219. DOI 10.1007/s40259-015-0133-6.

Strop, et al., "Generating Bispecific Human IgG1 and IgG2 Antibodies from Any Antibody Pair," JMB, vol. 420, Issue 3, Jul. 13, 2012, pp. 204-219.

Tam, et al., "Functional, Biophysical, and Structural Characterization of Human IgG1 and IgG4 Fc Variants with Ablated Immune Functionality," Open Access Antibodies, 2017, vol. 6, No. 12, pp. 1-34. doi:10.3390/antib6030012.

Tao and Morrison, "Studies of aglycosylated chimeric mouse-human IgG. Role of carbohydrate in the structure and effector functions mediated by the human IgG constant region," J. Immunol, 1989, vol. 143, No. 8, pp. 2595-2601. Abstract.

Trebing, et al., "CD70-restricted specific activation of TRAILR1 or TRAIL2 using scFv-targeted TRAIL mutants," Cell Death and Disease, 2014, vol. 5, e1035; doi:10.1038/cddis.2013.555.

Vaneycken, et al., "Preclinical Screening of Anti-HER2 Nanobodies for Molecular Imaging of Breast Cancer", The ASEB Journal, vol. 25, pp. 2433-2446, 2011.

Vafa, et al., 2014 Methods, vol. 65, Issue 1, Jan. 1, 2014, pp. 114-126.

Veronese and Harris, "Introduction and overview of peptide and protein pegylation," Adv. Drug Deliv. Rev., 2002, vol. 54, pp. 453-456.

Von Kreudenstein, et al., "Improving biophysical properties of a bispecific antibody scaffold to aid developability," 2013, mAbs, vol. 5, Issue 5, pp. 646-654. Supplemental material—11 pages.

Weber, et al., "Single Amino Acid Changes that Render Human IFN-α2 Biologically Active on Mouse Cells," The EMBO Journal, vol. 6, No. 3, pp. 591-598, 1987.

Wells, "Additivity of Mutational Effects in Proteins," Biochemistry, vol. 29, No. 37, pp. 8509-8517, 1990.

Wesolowski, et al., "Single Domain Antibodies: Promising Experimental and Therapeutic Tools in Infection and Immunity," Med. Microbiol. Immunol., vol. 198, pp. 157-174, 2009.

Yang, et al., "Tailoring structure±function and pharmacokinetic properties of single-chain Fv proteins by site-speci® c PEGylation," Protein Engineering, 2003, vol. 16, No. 10, pp. 761-770.

Youle, et al., "Anti-Thy 1.2 monoclonal antibody linked to ricin is a potent cell-type-specific toxin," Proc. Nat'l Acad. Sci. USA, September 198, vol. 7, No. 9, pp. 5483-5486.

Zitvogel, et al., "Type I interferons in anticancer immunity," The Journal of Immunology, vol. 15, No. 7, pp. 405-141, Jun. 1, 2015.

* cited by examiner

FIG. 11A    FIG. 11B    FIG. 11C    FIG. 11D
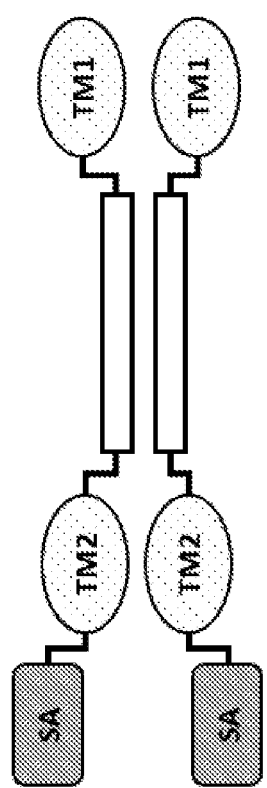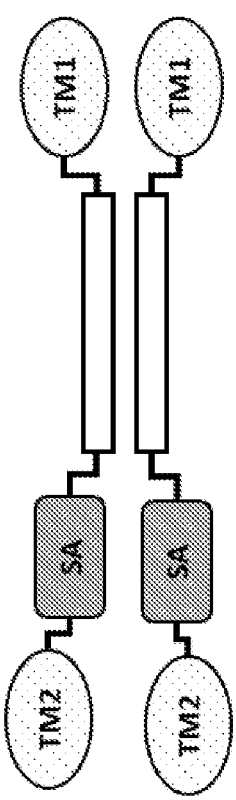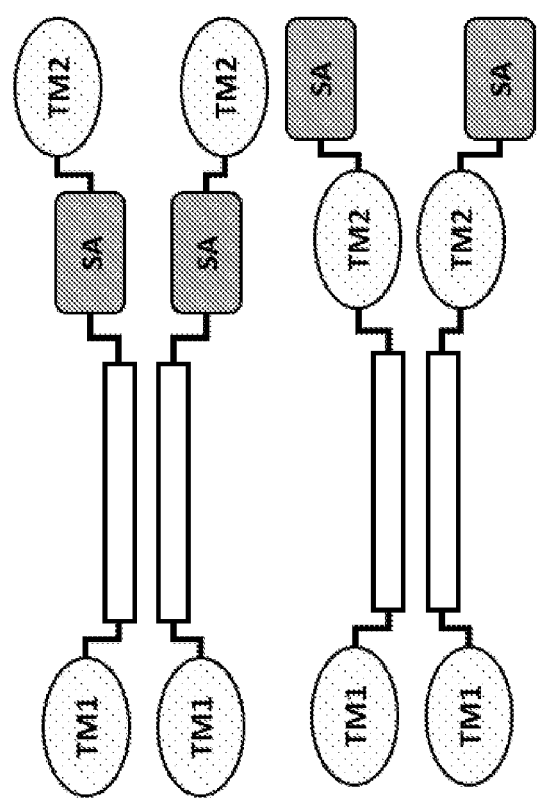

FIG. 11E  FIG. 11F  FIG. 11G  FIG. 11H
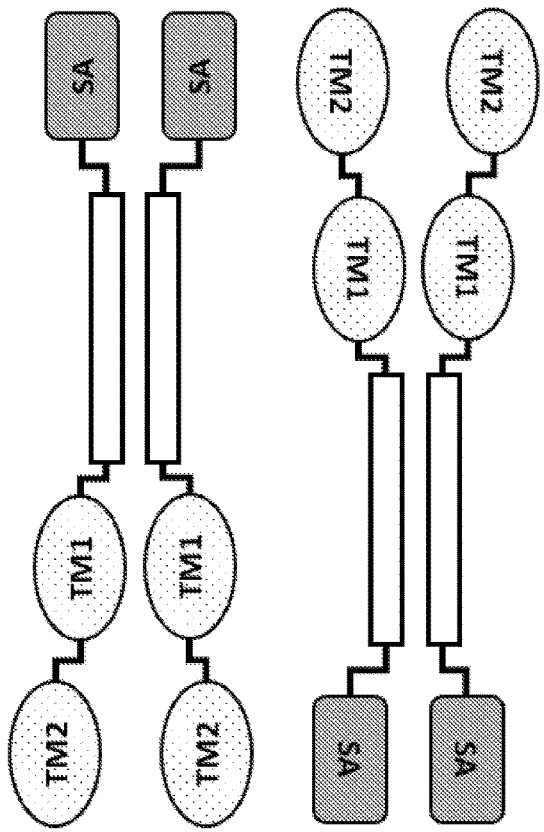
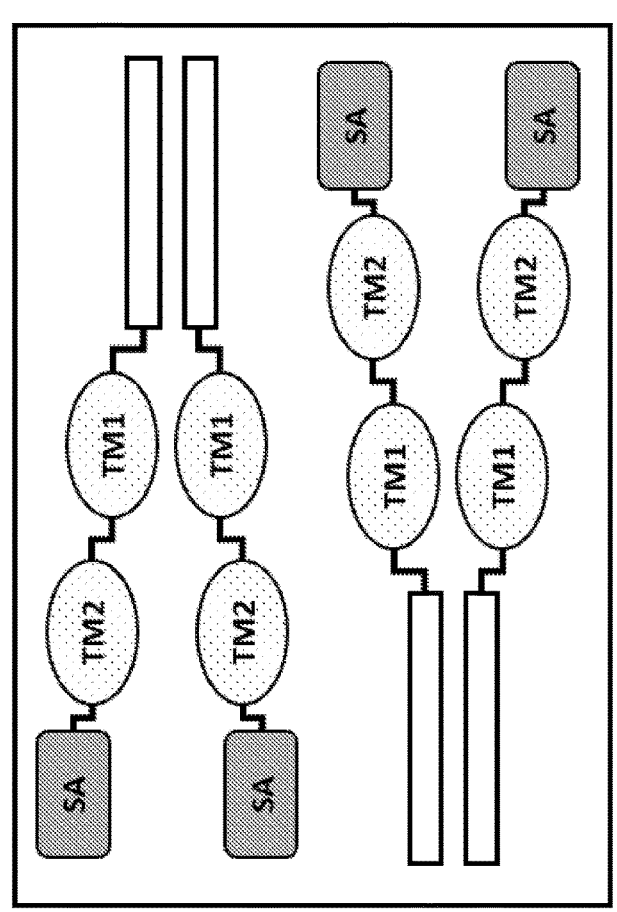

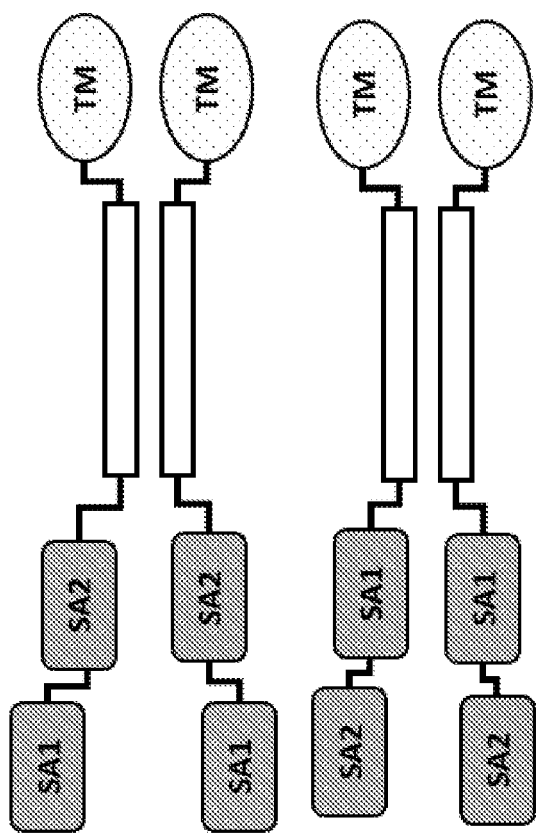 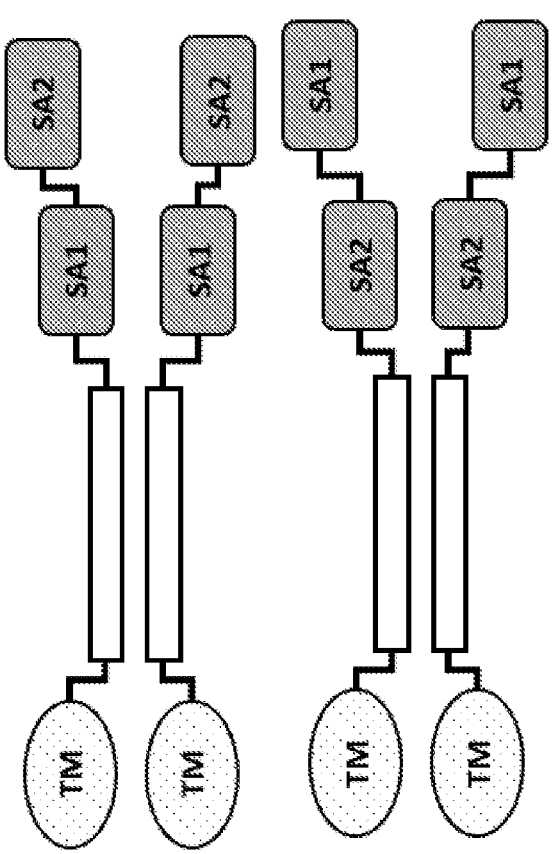
FIG. 12A  FIG. 12B  FIG. 12C  FIG. 12D

FIG. 13A    FIG. 13B    FIG. 13C    FIG. 13D
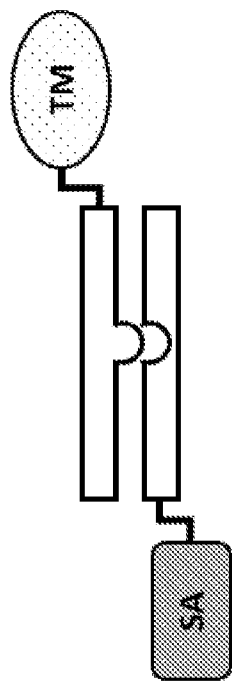
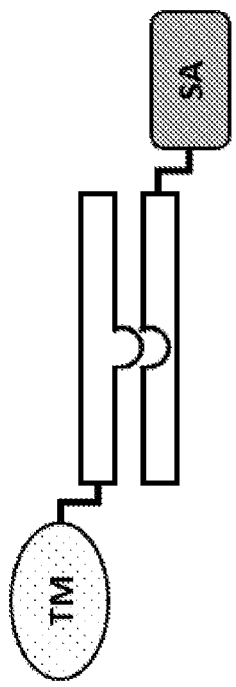
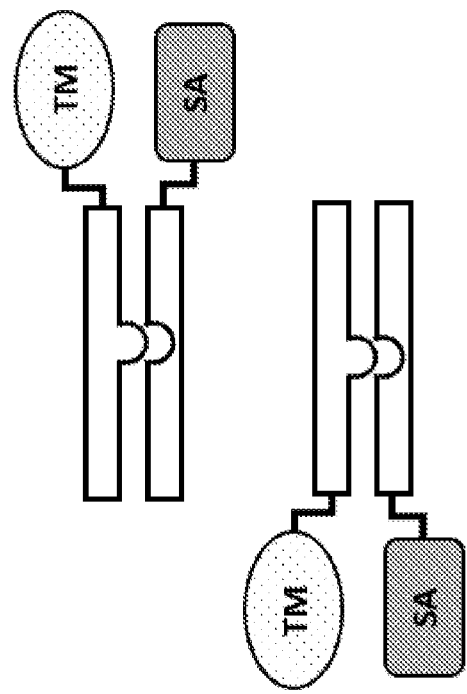

FIG. 14A  FIG. 14B  FIG. 14C  FIG. 14D  FIG. 14E  FIG. 14F
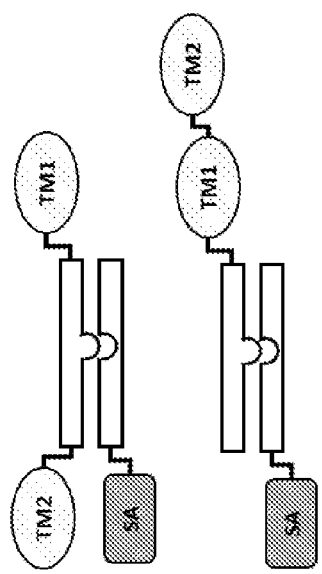 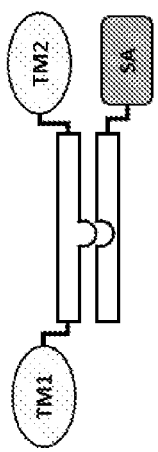 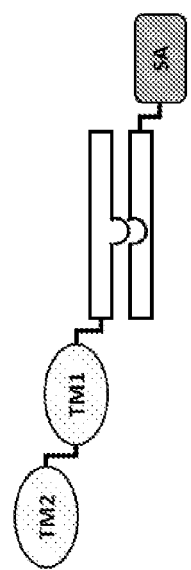 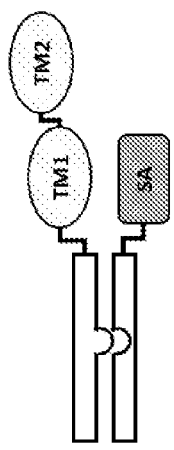 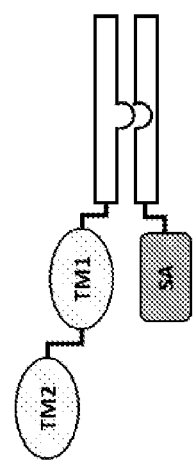

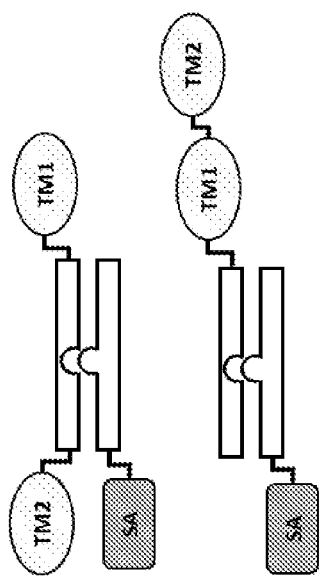 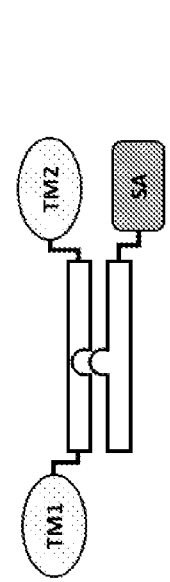 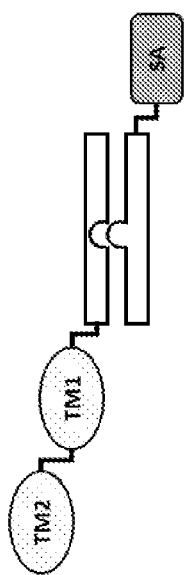 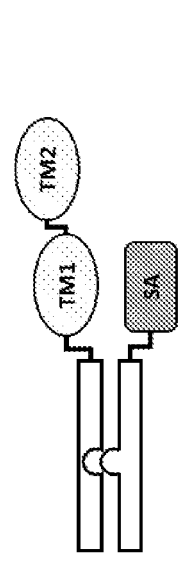 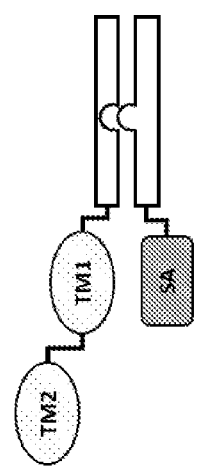
FIG. 17A  FIG. 17B    FIG. 17C    FIG. 17D    FIG. 17E    FIG. 17F FIG. 20A    FIG. 20B    FIG. 20C    FIG. 20D    FIG. 20E
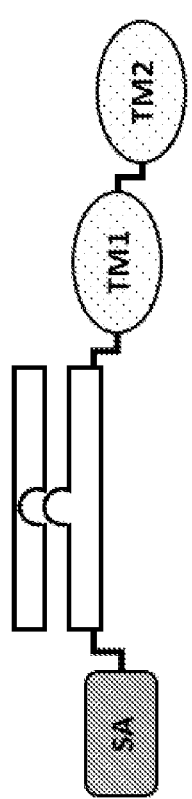
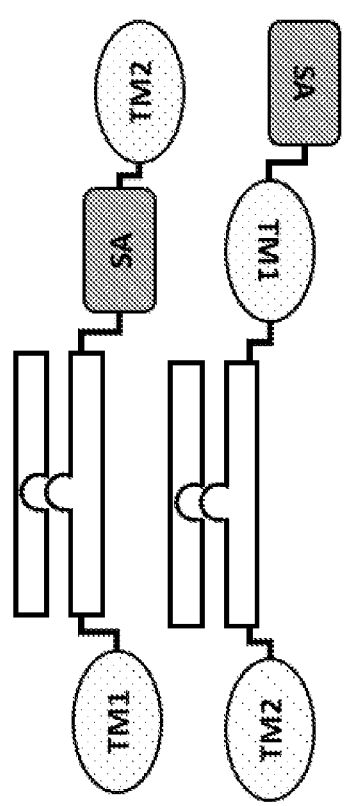
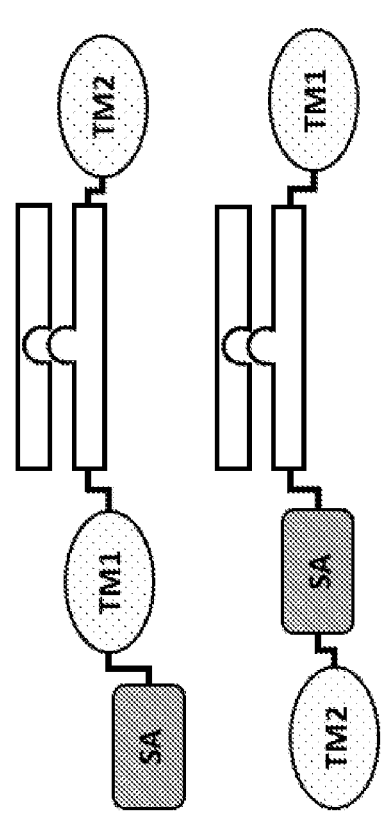

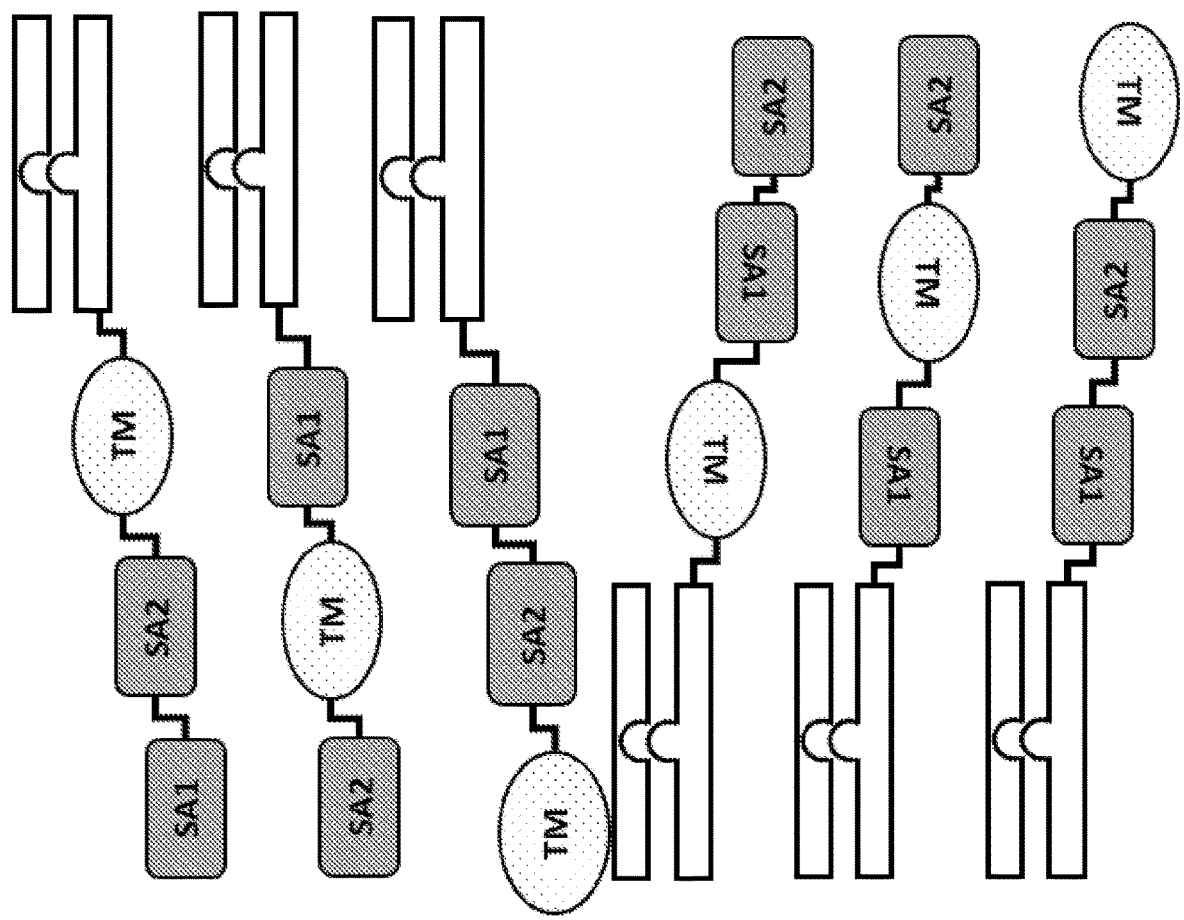

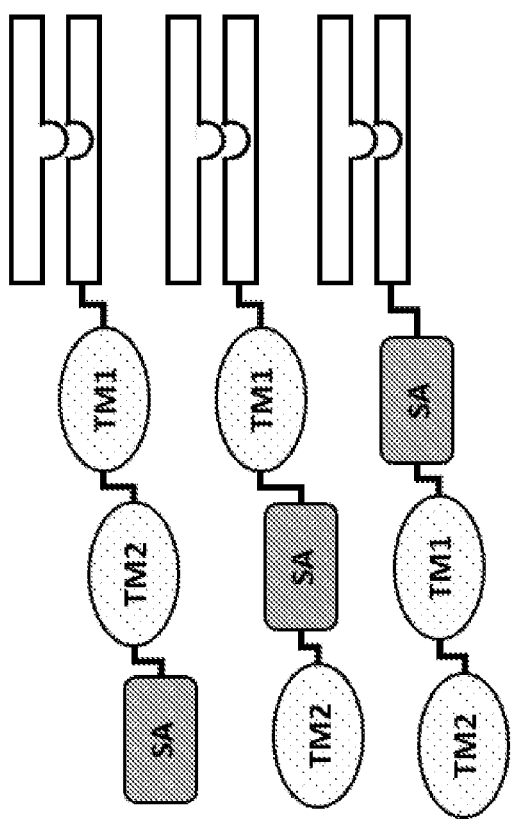
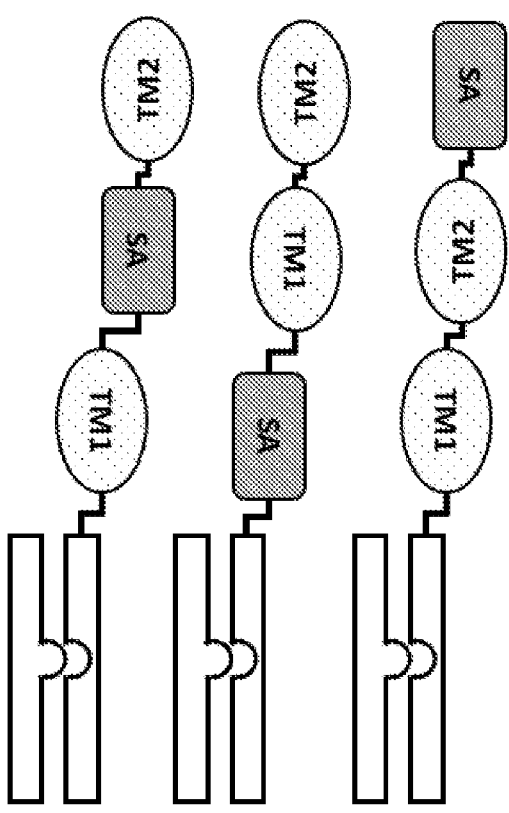
FIG. 23G  FIG. 23H  FIG. 23I    FIG. 23J  FIG. 23K  FIG. 23L FIG. 27A   FIG. 27B   FIG. 27C   FIG. 27D   FIG. 27E   FIG. 27F
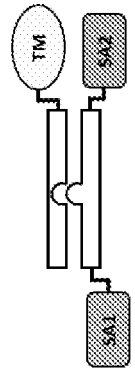 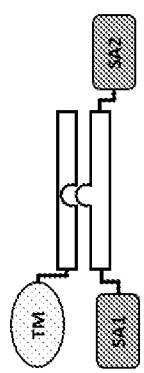 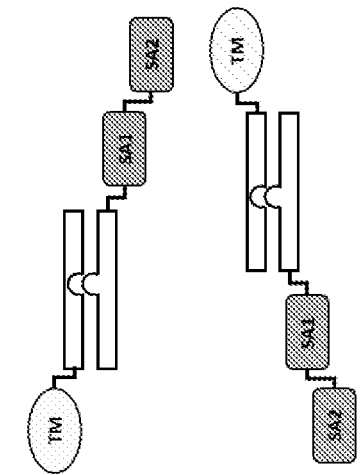 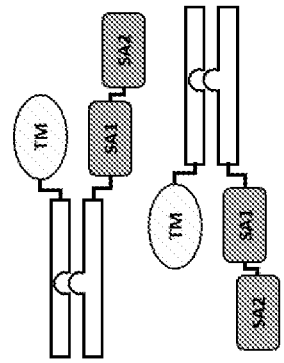 

FIG. 28A    FIG. 28B    FIG. 28C  FIG. 28D    FIG. 28E   FIG. 28F
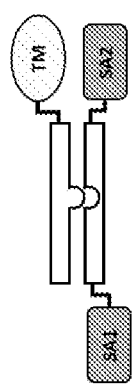 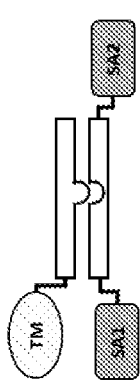 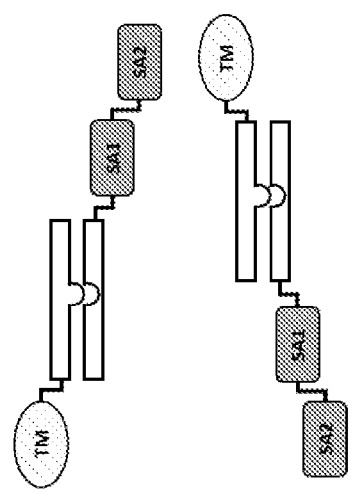 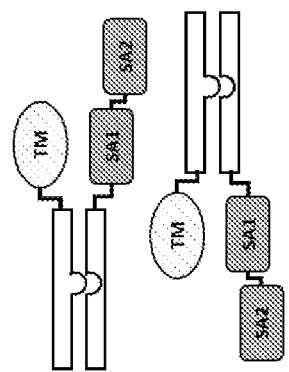

MODULATION OF DENDRITIC CELL LINEAGES

CROSS-REFERENCE TO RELATED APPLICATIONS

This application is a national stage entry of PCT/US19/60291, filed Nov. 7, 2019, which claims the benefit of U.S. Provisional Patent Application No. 62/757,643, filed Nov. 8, 2018, the entire contents of which are hereby incorporated by reference in their entirety.

FIELD

The present invention relates, in part, to targeting moieties that recognize and bind Clec4C and their use as diagnostic and therapeutic agents. The present invention further relates to chimeric proteins, chimeric protein complexes, and pharmaceutical compositions comprising chimeric proteins and chimeric protein complexes having a plasmacytoid dendritic cell (pDC) targeting moiety, e.g. Clec4C, and their use in the treatment of various diseases, including autoimmunity.

SEQUENCE LISTING

The instant application contains a Sequence Listing which has been submitted in ASCII format via EFS-Web and is hereby incorporated by reference in its entirety. Said ASCII copy, recorded on May 7, 2021, is named "ORN-051 ST25.txt" and is 944,568 bytes in size.

BACKGROUND

Dendritic cells (DCs) are antigen-presenting cells (APCs) that process antigens and display them to other cells of the immune system. Specifically, dendritic cells are capable of capturing and presenting antigens on their surfaces to regulate the function of T cells such as CD4+ helper T cells, CD8+ cytotoxic T cells (CTLs) and regulatory T cells (Tregs). Further, activated dendritic cells are capable of recruiting additional immune cells such as macrophages, eosinophils, natural killer cells, and natural killer T cells.

Given the important role of dendritic cells in immunity, derailed dendritic cell functions have been implicated in diseases such as cancer and autoimmune diseases such as multiple sclerosis. For example, cancer cells may evade immune detection and destruction by crippling dendritic cell functionality through prevention of dendritic cell recruitment, activation and function. In addition, dendritic cells have been found in the brain during central nervous system inflammation and may be involved in the pathogenesis of autoimmune diseases in the brain.

Dendritic cell subtypes or lineages include conventional dendritic cell (cDC), which include cDC-1, which is a major stimulator of T cells and cDC-2, which may have a function in fighting infection. Without wishing to be bound by theory, cDCs are characterized by interleukin 12 (IL-12) secretion and TLR 2/TLR 4 expression. A further dendritic cell subtype or lineage are plasmacytoid dendritic cells (pDCs). Without wishing to be bound by theory, pDCs can produce high amounts of interferon-alpha and are characterized by TLR 7/TLR 9 expression. pDC and cDC modulate differing but complex aspects of the immune system.

Accordingly, there remains a need for improved therapies for diseases including cancer and autoimmune diseases such as multiple sclerosis by modifying dendritic cell functions, including modifying specific DC subtypes or lineages.

SUMMARY

In various aspects, the present invention relates to pDC, e.g. Clec4C as a pDC cell surface marker, binding agents having at least one targeting moiety that specifically binds to a pDC, e.g. via Clec4C. In various embodiments, these binding agents bind to, but do not functionally modulate (e.g. partially or fully neutralize) the pDC marker, e.g. Clec4C. Therefore, in various embodiments, the present pDC marker, e.g. Clec4C, binding agents have use in, for instance, directly or indirectly recruiting a pDC, e.g. a Clec4C-expressing, cell to a site of interest while still allowing the pDC, e.g. Clec4C-expressing, cell to signal via pDC marker, e.g. Clec4C (e.g. the binding of the Clec4C binding agent does not reduce or eliminate Clec4C signaling at the site of interest). In an embodiment, the targeting moiety is a single domain antibody (VHH).

In various embodiments, the pDC marker binding agent further comprises a signaling agent, e.g., without limitation, an interferon, an interleukin, a chemokine and a tumor necrosis factor, that may be modified to attenuate activity. In various embodiments, the pDC marker binding agent comprises additional targeting moieties that bind to other targets (e.g. antigens, receptor) of interest. In an embodiment, the other targets (e.g. antigens, receptor) of interest are present on tumor cells. In another embodiment, the other targets (e.g. antigens, receptor) of interest are present on immune cells. In some embodiments, the present pDC marker binding agent may directly or indirectly recruit an immune cell (e.g. a dendritic cell) to a site of action (such as, by way of non-limiting example, the tumor microenvironment). In some embodiments, the present pDC marker binding agent facilitates the presentation of antigens (e.g., tumor antigens) by dendritic cells. In an embodiment, the other targets (e.g. antigens, receptor) of interest are present on cells, tissues, and organ sites affected by autoimmune disease. In some embodiments, the present pDC marker binding agent may directly or indirectly recruit an immune cell (e.g. a dendritic cell) to a site of action (such as, by way of non-limiting example, cells, tissues, and organ sites affected by autoimmune disease).

In various embodiments, the Clec4C binding agent further comprises a signaling agent, e.g., without limitation, an interferon, an interleukin, a chemokine and a tumor necrosis factor, that may be modified to attenuate activity. In various embodiments, the Clec4C binding agent comprises additional targeting moieties that bind to other targets (e.g. antigens, receptor) of interest. In an embodiment, the other targets (e.g. antigens, receptor) of interest are present on tumor cells. In another embodiment, the other targets (e.g. antigens, receptor) of interest are present on immune cells. In some embodiments, the present Clec4C binding agent may directly or indirectly recruit an immune cell (e.g. a dendritic cell) to a site of action (such as, by way of non-limiting example, the tumor microenvironment). In some embodiments, the present Clec4C binding agent facilitates the presentation of antigens (e.g., tumor antigens) by dendritic cells. In an embodiment, the other targets (e.g. antigens, receptor) of interest are present on cells, tissues, and organ sites affected by autoimmune disease. In some embodiments, the present pDC marker binding agent may directly or indirectly recruit an immune cell (e.g. a dendritic cell) to a site of action (such as, by way of non-limiting example, cells, tissues, and organ sites affected by autoimmune disease).

The present technology also provides fragment crystallizable region (Fc)-based chimeric protein complexes in which most, if not all, of the above outlined requirements are met. These constructs encode biological therapeutic agents whose effector function can be delivered in a highly precise fashion to a target of choice and without, or with a mitigated amount of systemic adverse events, thereby limiting systemic cross-reactivities and associated adverse events, while also providing features that impart pharmaceutical properties enabling the production of therapeutic agents with, for example, desired in vivo exposure time (e.g. half-life), size (e.g. for biodistribution and clearance characteristics), as well as large scale production and/or purification for commercial production (e.g. having adequate solubility, purity, stability and storage properties).

In some aspects, the present technology relates to Fc-based chimeric protein complexes including i) a targeting moiety that comprises a recognition domain which recognizes and/or binds to a pDC, e.g. via Clec4C, or a Clec4C binding agent as disclosed above. The Fc-based chimeric protein complexes may further include a wild type or modified signaling agent, wherein the modified signaling agent has one or more mutations that confer improved safety relative to a wild type signaling agent, and an Fc domain, having one or more Fc chains.

In some embodiments, the Fc domain has one or more mutations that reduce or eliminate an effector function of the Fc domain, promote Fc chain pairing of the Fc domain, and/or stabilize a hinge region in the Fc domain. In some embodiments, the one or more Fc chains of the Fc domain have one or more mutations that reduce or eliminate an effector function of the Fc domain, promote Fc chain pairing of the Fc domain, and/or stabilize a hinge region in the Fc domain.

In some embodiments, such Fc-based chimeric protein complexes are heterodimeric. In some embodiments, the Fc-based chimeric protein complexes are heterodimeric and the targeting moiety and the signaling agent are oriented in trans. In some embodiments, the Fc-based chimeric protein complexes are heterodimeric and pairing is via Ridgway knob-in-hole construction (as described herein). In some embodiments, the Fc-based chimeric protein complexes are heterodimeric and pairing is via Merchant knob-in-hole construction (as described herein).

In some embodiments, such Fc-based chimeric protein complexes are homodimeric.

In some embodiments, the one or more mutations in the modified signaling agent reduces the affinity or activity at the signaling agent's receptor relative to a wild type signaling agent. In some embodiments, the targeting moiety restores the affinity or activity of the modified signaling agent.

In some embodiments, the Fc-based chimeric protein complexes comprise one or more additional targeting moieties and/or wild type or modified signaling agents. In some embodiments, the Fc-based chimeric protein complexes are multispecific. In some embodiments, the targeting moieties are a single domain antibody (VHH).

In another aspect, the present technology relates to the use of Fc-based chimeric protein complexes to treat or prevent various diseases and disorders. In some embodiments, the Fc-based chimeric protein complexes are used to treat cancer, infections, metabolic diseases, (neuro)degenerative diseases, and cardiovascular diseases and immune disorders.

In various embodiments, the present pDC marker binding agents find use in the treatment of various diseases or disorders such as autoimmune diseases, cancer, infections, immune disorders, and other diseases and disorders, and the present invention encompasses various methods of treatment.

In various embodiments, the present Clec4C binding agents find use in the treatment of various diseases or disorders such as autoimmune diseases, cancer, infections, immune disorders, and other diseases and disorders, and the present invention encompasses various methods of treatment.

BRIEF DESCRIPTION OF DRAWINGS

FIGS. 10A-F, 11A-H, 12A-H, 13A-D, 14A-F, 15A-J, 16A-D, 17A-F, 18A-J, 19A-F, 20A-L, 21A-L, 22A-F, 23A-L, 24A-L, 25A-J, 26A-J, 27A-F, 28A-F, 29A-E, and 29A-D show various non-limiting illustrative schematics of the Fc-based chimeric protein complexes of the present invention. In embodiments, each schematic is a composition of the present invention. Where applicable in the figures, "TM" refers to a "targeting moiety" as described herein, "SA" refers to a "signaling agent" as described herein, is an optional "linker" as described herein, the two long parallel rectangles are human Fc domains, having one or more Fc chains, e.g. from IgG1, from IgG2, or from IgG4, as described herein and optionally with effector knock-out and/or stabilization mutations as also described herein, and the two long parallel rectangles with one having a protrusion and the other having an indentation are human Fc domains, having one or more Fc chains, e.g. from IgG1, from IgG2, or from IgG4 as described herein, with knob-in-hole and/or ionic pair (a/k/a charged pairs, ionic bond, or charged residue pair) mutations as described herein and optionally with effector knock-out and/or stabilization mutations as also described herein.

FIGS. 10A-F show illustrative homodimeric 2-chain complexes. These figures show illustrative configurations for the homodimeric 2-chain complexes.

FIGS. 11A-H show illustrative homodimeric 2-chain complexes with two targeting moieties (TM) (as described herein, more targeting moieties may be present in some embodiments). In embodiments, the position of TM1 and TM2 are interchangeable. In embodiments, the constructs shown in the box (i.e., FIGS. 11B and 11C) have signaling agent (SA) between TM1 and TM2 or between TM1 and Fc.

FIGS. 12A-H show illustrative homodimeric 2-chain complexes with two signaling agents (as described herein, more signaling agents may be present in some embodiments). In embodiments, the position of SA1 and SA2 are interchangeable. In embodiments, the constructs shown in the box (i.e., FIGS. 12G and 12H) have TM between SA1 and SA2 or TM at N- or C-terminus.

FIGS. 13A-D show illustrative heterodimeric 2-chain complexes with split TM and SA chains, namely the TM on the knob chain of the Fc and the SA on hole chain of the Fc.

FIGS. 14A-F show illustrative heterodimeric 2-chain complexes with split TM and SA chains, namely with both TMs on the knob chain of the Fc and with SA on hole chain of the Fc, with two targeting moieties (as described herein, more targeting moieties may be present in some embodiments). In embodiments, the position of TM1 and TM2 are interchangeable. In some embodiments, TM1 and TM2 can be identical.

FIGS. 15A-J show illustrative heterodimeric 2-chain complexes with split TM and SA chains, namely with TM on the knob chain of the Fc and with a SA on the hole chain of the Fc, with two signaling agents (as described herein, more signaling agents may be present in some embodiments). In these orientations/configurations, one SA is on the knob chain and one SA is on the hole chain. In embodiments, the position of SA1 and SA2 are interchangeable.

FIGS. 16A-D show illustrative heterodimeric 2-chain complexes with split TM and SA chains, namely the SA on the knob chain of the Fc and the TM on hole chain of the Fc.

FIGS. 17A-F show illustrative heterodimeric 2-chain complexes with split TM and SA chains, namely with SA on the knob chain of the Fc and both TMs on hole chain of the Fc, with two targeting moieties (as described herein, more targeting moieties may be present in some embodiments). In embodiments, the position of TM1 and TM2 are interchangeable. In some embodiments, TM1 and TM2 can be identical.

FIGS. 18A-J show illustrative heterodimeric 2-chain complexes with split TM and SA chains, namely with SA on the knob chain of the Fc and TM on hole chain of the Fc, with two signaling agents (as described herein, more signaling agents may be present in some embodiments). In these orientations/configurations, one SA is on the knob chain and one SA is on the hole chain. In embodiments, the position of SA1 and SA2 are interchangeable.

FIGS. 19A-F show illustrative heterodimeric 2-chain complexes with TM and SA on the same chain, namely the SA and TM both on the knob chain of the Fc.

FIGS. 20A-L show illustrative heterodimeric 2-chain complexes with a TM and a SA on the same chain, namely with SA and with TM both on the knob chain of the Fc, with two targeting moieties (as described herein, more targeting moieties may be present in some embodiments). In embodiments, the position of TM1 and TM2 are interchangeable. In some embodiments, TM1 and TM2 can be identical.

FIGS. 21A-L show illustrative heterodimeric 2-chain complexes with a TM and a SA on the same chain, namely with SA and with TM both on the knob chain of the Fc, with two signaling agents (as described herein, more signaling agents may be present in some embodiments). In embodiments, the position of SA1 and SA2 are interchangeable.

FIGS. 22A-F show illustrative heterodimeric 2-chain complexes with TM and SA on the same chain, namely the SA and TM both on the hole chain of the Fc.

FIGS. 23A-L show illustrative heterodimeric 2-chain complexes with a TM and a SA on the same chain, namely with SA and with TM both on the hole chain of the Fc, with two targeting moieties (as described herein, more targeting moieties are present in some embodiments). In embodiments, the position of TM1 and TM2 are interchangeable. In embodiments, TM1 and TM2 can be identical.

FIGS. 24A-L show illustrative heterodimeric 2-chain complexes with a TM and a SA on the same chain, namely with SA and with TM both on the hole chain of the Fc, with two signaling agents (as described herein, more signaling agents may be present in some embodiments). In embodiments, the position of SA1 and SA2 are interchangeable.

FIGS. 25A-J show illustrative heterodimeric 2-chain complexes with two targeting moieties (as described herein, more targeting moieties may be present in some embodiments) and with SA on knob Fc and TM on each chain. In embodiments, TM1 and TM2 can be identical.

FIGS. 26A-J show illustrative heterodimeric 2-chain complexes with two targeting moieties (as described herein, more targeting moieties may be present in some embodiments) and with SA on hole Fc and TM on each chain. In embodiments, TM1 and TM2 can be identical.

FIGS. 27A-F show illustrative heterodimeric 2-chain complexes with two signaling agents (as described herein, more signaling agents may be present in some embodiments) and with split SA and TM chains: SA on knob and TM on hole Fc.

FIGS. 28A-F show illustrative heterodimeric 2-chain complexes with two signaling agents (as described herein, more signaling agents may be present in some embodiments) and with split SA and TM chains: TM on knob and SA on hole Fc.

FIGS. 29A-D show illustrative heterodimeric 2-chain complexes with two targeting moieties (as described herein, more targeting moieties are present in some embodiments) and with SA on knob Fc and TM on each chain. Each targeting moiety is present in 2 copies and the positions of TM1 and TM2 are interchangeable.

DETAILED DESCRIPTION

Figure 1:
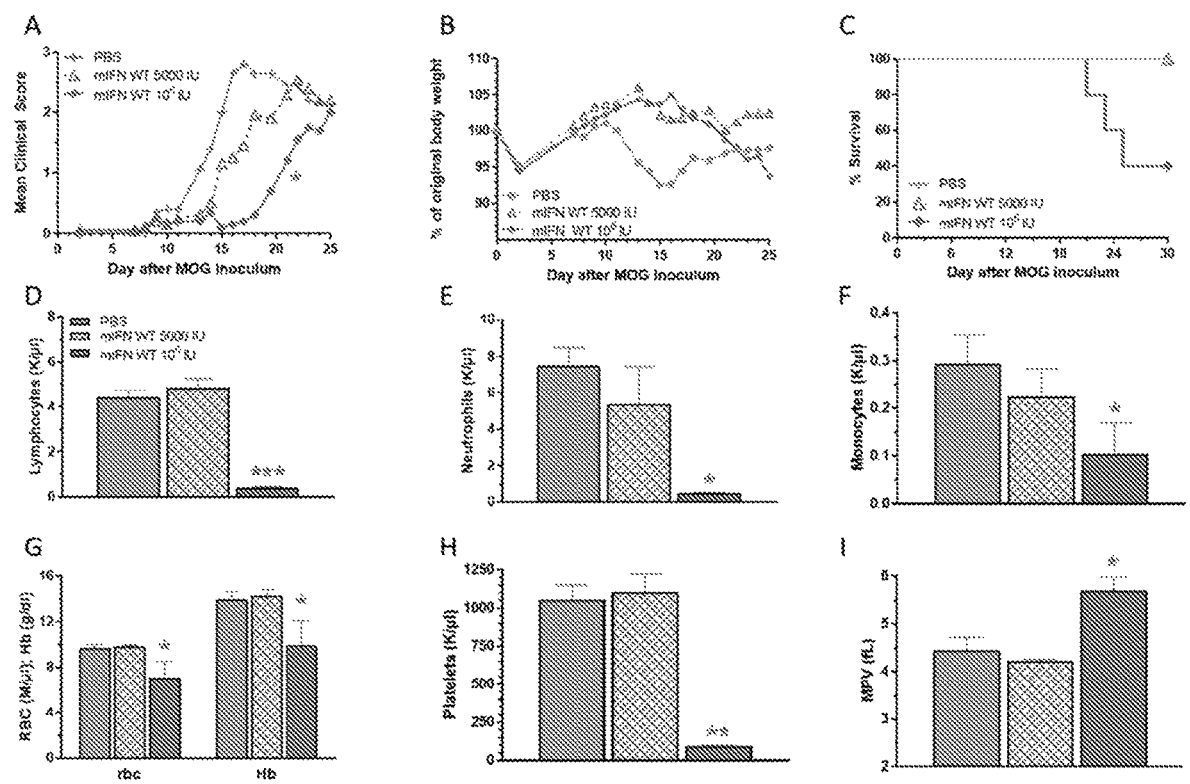
FIG. 1 shows that WT mIFNα protects dose-dependently, but is associated with severe toxicity. Mice were immunized on d0, and treated d7-25 with 5000 or $10^6$ IU mIFNα daily. Clinical score (A) and body weights (B) were determined daily. High dose mIFNα caused mortality (C) and severe haematological deficits (D-I). Shown is a representative experiment (n=5). Differences were assessed using two-way ANOVA followed by Dunnett's multiple-comparison test; *P<0.05, P<0.01, *P<0.001 compared with PBS treated animals.

The present invention is based, in part, on the discovery of agents (e.g. antibodies such as, by way of non-limiting example, VHHs) that selectively modulate pDC cells. The present invention is based, in part, on the discovery of agents (e.g. antibodies such as, by way of non-limiting example, VHHs) that recognize and bind to Clec4C. In some embodiments, the present pDC marker binding agents are part of a chimeric or fusion protein with one or more targeting moieties and/or one or more signaling agents. In some embodiments, the present Clec4C binding agents are part of a chimeric or fusion protein with one or more targeting moieties and/or one or more signaling agents. In some embodiments, these Clec4C binding agents bind to, but do not functionally modulate Clec4C.

In some embodiments, the present compositions and methods allow for immune modulation by targeting DCs, e.g. pDCs alone. That is, in embodiments, the compositions and methods relate to a selective modulation of pDC cells. For example, the present Clec4C binding agents and/or chimeric proteins or chimeric protein complexes having the present Clec4C binding agents provide selective modulation of pDCs over, for instance, cDC.

In some embodiments, the present compositions and methods allow for immune modulation by targeting DCs, e.g. pDCs and cDCs. That is, in embodiments, the compositions and methods relate to a combined modulation of pDCs and cDCs. For example, the present Clec4C binding agents and/or chimeric proteins or chimeric protein complexes having the present Clec4C binding agents are combined with Clec9A binding agents, as described herein, and/or chimeric proteins or chimeric protein complexes having the present Clec9A binding agents to provide selective modulation of pDCs and cDCs. Further, in embodiments, the multi-specific formats described herein (e.g. involving a chimeric protein or chimeric protein complex having two or more recognition domains) allow for targeting of Clec4C and Clec9A in the same agent (e.g. a chimeric protein or chimeric protein complex targeting Clec4C and Clec9A and comprising a modified signaling agent, e.g. a modified human IFNα). For example, the present Clec4C binding agents and/or chimeric proteins or chimeric protein complexes having the present Clec4C binding agents are combined with an XCR1 binding agent, for example an antibody or antibody format directed against XCR1, the ligand XCL1, or the ligand XCL2, as described herein, and/or chimeric proteins or chimeric protein complexes having the present XCR1 binding agents to provide selective modulation of pDCs and cDCs. Further, in embodiments, the multi-specific formats described herein (e.g. involving a chimeric protein or chimeric protein complex having two or more recognition domains) allow for targeting of Clec4C and XCR1 in the same agent (e.g. a chimeric protein or chimeric protein complex targeting Clec4C and XCR1 and comprising a modified signaling agent, e.g. a modified human IFNα).

In some embodiments, these Clec4C binding agents may bind and directly or indirectly recruit immune cells to sites in need of therapeutic action. In some embodiments, the present Clec4C binding agents exhibit beneficial therapeutic properties and reduced side effects. In some embodiments, the Clec4C binding agents enhance an immune response and, in embodiments, avoid or reduce autoimmunity.

In various embodiments, the Clec4C binding agents modulate antigen presentation. In some embodiments, the Clec4C binding agents temper the immune response to avoid or reduce autoimmunity. In some embodiments, the Clec4C binding agents provide immunosuppression. In some embodiments, the Clec4C binding agents cause an increase a ratio of Tregs to CD8+ T cells and/or CD4+ T cells in a patient. In some embodiments, the present methods relate to reduction of auto-reactive T cells in a patient.

The present invention provides pharmaceutical compositions comprising the Clec4C binding agents and their use in the treatment of various diseases, including autoimmune diseases.

pDC and Clec4C Binding Agents

In various embodiments, the invention relates to a pDC marker binding agent.

In various embodiments, the present pDC marker binding agents find use in the treatment of various diseases or disorders such as autoimmune diseases, cancer, infections, immune disorders, and other diseases and disorders, and the present invention encompasses various methods of treatment.

In various embodiments, the present Clec4C binding agents find use in the treatment of various diseases or disorders such as autoimmune diseases, cancer, infections, immune disorders.

In various embodiments, the present Clec4C binding agent is a protein-based agent capable of specific binding to Clec4C. In various embodiments, the present Clec4C binding agent is a protein-based agent capable of specific binding to Clec4C without functional modulation (e.g., partial or full neutralization) of Clec4C. Clec4C is a type II transmembrane glycoprotein that belongs to the C-type lectin (CTLs) superfamily, found on the surface of plasmacytoid dendritic cells (pDC) specialized for secretion of type I IFN and the detection of viral nucleic acids. Clec4C is a receptor that inhibits type I IFN secretion, thereby preventing immune surveillance. Clec4C binding agents are involved in various other pDC functions, such as inhibition of soluble TNF-related apoptosis-inducing ligand (TRAIL) secretion. Clec4C was also shown to function as an antigen receptor, which pDCs use to internalize and process certain antigens which are then presented to T cells. (Riboldi et al. Human C-type Lectin Domain Family 4, Member C (CLEC4C/BDCA-2/CD303) Is a Receptor for Asialo-galactosyl-oligosaccharides, J Biol Chem. 2011 Oct. 14; 286(41): 35329-35333.

In various embodiments, the Clec4C binding agent of the invention comprises a targeting moiety having an antigen recognition domain that recognizes an epitope present on Clec4C. In an embodiment, the antigen-recognition domain recognizes one or more linear epitopes present on Clec4C. As used herein, a linear epitope refers to any continuous sequence of amino acids present on Clec4C. In another embodiment, the antigen-recognition domain recognizes one or more conformational epitopes present on Clec4C. As used herein, a conformation epitope refers to one or more sections of amino acids (which may be discontinuous) which form a three-dimensional surface with features and/or shapes and/or tertiary structures capable of being recognized by an antigen recognition domain.

In various embodiments, the Clec4C binding agent of the present invention may bind to the full-length and/or mature forms and/or isoforms and/or splice variants and/or fragments and/or any other naturally occurring or synthetic analogs, variants, or mutants of human Clec4C. In various embodiments, the Clec4C binding agent of the invention may bind to any forms of the human Clec4C, including monomeric, dimeric, heterodimeric, multimeric and associated forms. In an embodiment, the Clec4C binding agent binds to the monomeric form of Clec4C. In another embodiment, the Clec4C binding agent binds to a dimeric form of Clec4C. In a further embodiment, the Clec4C binding agent binds to glycosylated form of Clec4C, which may be either monomeric or dimeric.

In various embodiments, the pDC marker binding agent further comprises a signaling agent, e.g., without limitation, an interferon, an interleukin, a chemokine and a tumor necrosis factor, that may be modified to attenuate activity. In various embodiments, the pDC marker binding agent comprises additional targeting moieties that bind to other targets (e.g. antigens, receptor) of interest. In an embodiment, the other targets (e.g. antigens, receptor) of interest are present on tumor cells. In another embodiment, the other targets (e.g. antigens, receptor) of interest are present on immune cells. In some embodiments, the present pDC marker binding agent may directly or indirectly recruit an immune cell (e.g. a dendritic cell) to a site of action (such as, by way of non-limiting example, the tumor microenvironment). In some embodiments, the present pDC marker binding agent facilitates the presentation of antigens (e.g., tumor antigens) by dendritic cells. In an embodiment, the other targets (e.g. antigens, receptor) of interest are present on cells, tissues, and organ sites affected by autoimmune disease. In some embodiments, the present pDC marker binding agent may directly or indirectly recruit an immune cell (e.g. a dendritic cell) to a site of action (such as, by way of non-limiting example, cells, tissues, and organ sites affected by autoimmune disease).

In various embodiments, the Clec4C binding agent further comprises a signaling agent, e.g., without limitation, an interferon, an interleukin, a chemokine and a tumor necrosis factor, that may be modified to attenuate activity. In various embodiments, the Clec4C binding agent comprises additional targeting moieties that bind to other targets (e.g. antigens, receptor) of interest. In an embodiment, the other targets (e.g. antigens, receptor) of interest are present on tumor cells. In another embodiment, the other targets (e.g. antigens, receptor) of interest are present on immune cells. In some embodiments, the present Clec4C binding agent may directly or indirectly recruit an immune cell (e.g. a dendritic cell) to a site of action (such as, by way of non-limiting example, the tumor microenvironment). In some embodiments, the present Clec4C binding agent facilitates the presentation of antigens (e.g., tumor antigens) by dendritic cells. In an embodiment, the other targets (e.g. antigens, receptor) of interest are present on cells, tissues, and organ sites affected by autoimmune disease. In some embodiments, the present pDC marker binding agent may directly or indirectly recruit an immune cell (e.g. a dendritic cell) to a site of action (such as, byway of non-limiting example, cells, tissues, and organ sites affected by autoimmune disease).

In various embodiments, the present pDC marker binding agents and/or Clec4C binding agents, inclusive of chimeric proteins or chimeric protein complexes comprising the same, find use in the treatment of various diseases or disorders such as autoimmune diseases or disorders. In various embodiments, the present pDC marker binding agents and/or Clec4C binding agents, inclusive of chimeric proteins or chimeric protein complexes comprising the same, find use in inducing immune tolerance.

In various embodiments, the present pDC marker binding agents and/or Clec4C binding agents, inclusive of chimeric proteins or chimeric protein complexes comprising the same, find use in modulating the immune system. In embodiments, the present pDC marker binding agents and/or Clec4C binding agents, inclusive of chimeric proteins or chimeric protein complexes comprising the same, find use in preferentially effecting pDCs over, for example, cDC. In embodiments, the present pDC marker binding agents and/or Clec4C binding agents, inclusive of chimeric proteins or chimeric protein complexes comprising the same, find use in preferentially delivering an IFN signal to pDCs over, for example, cDC. In embodiments, the present pDC marker binding agents and/or Clec4C binding agents, inclusive of chimeric proteins or chimeric protein complexes comprising the same, find use in modulating pDCs and, accordingly increasing the number of suppressive immune cells such as those described elsewhere herein (e.g., without limitation, Tregs). In various embodiments, the present pDC marker binding agents and/or Clec4C binding agents, inclusive of chimeric proteins or chimeric protein complexes comprising the same, shift the ratio of immune cells in a subject to favor suppressive immune cells e.g. myeloid-derived suppressor cells (MDSCs), regulatory T cells (Tregs); tumor associated neutrophils (TANs), M2 macrophages, tumor associated macrophages (TAMs), or subsets thereof over immune stimulated cells e.g. anti-tumor macrophages (e.g. M1 macrophages), T cells, cytotoxic T lymphocytes, T helper cells, natural killer (NK) cells, natural killer T (NKT) cells, B cells, and dendritic cells.

In various embodiments, the present pDC marker binding agents and/or Clec4C binding agents, inclusive of chimeric proteins or chimeric protein complexes comprising the same, induce expression of PD-L1 and/or CTLA-4, e.g., without limitation in pDCs.

In various embodiments, the present pDC marker binding agents and/or Clec4C binding agents, inclusive of chimeric proteins or chimeric protein complexes comprising the same, target IFN type 1 signaling (e.g. via attenuated human IFN-α2, e.g. human IFN-α2 bearing a R149A mutation) to pDCs can elicit a tolerogenic effect and protect, inhibit, reverse autoimmune conditions.

In various embodiments, the present compositions and methods find use not only in targeting pDCs but also in targeting cDCs. For instance, in various embodiments, the present invention relates to a co-administration of the present pDC marker binding agents and/or Clec4C binding agents, inclusive of chimeric proteins or chimeric protein complexes comprising the same, and Clec9A binding agents (such as those described herein), inclusive of chimeric proteins or chimeric protein complexes comprising the same. In various embodiments, the present invention relates to a co-administration of the present pDC marker binding agents and/or Clec4C binding agents, inclusive of chimeric proteins or chimeric protein complexes comprising the same (e.g. linked to attenuated human IFN-α2, optionally being a human IFN-α2 bearing a R149A mutation), and Clec9A binding agents (such as those described herein), inclusive of chimeric proteins or chimeric protein complexes comprising the same e.g. linked to attenuated human IFN-α2, optionally being a human IFN-α2 bearing a R149A mutation).

In an embodiment, the present Clec4C binding agent comprises a targeting moiety with an antigen recognition domain that recognizes one or more epitopes present on human Clec4C. In an embodiment, the human Clec4C extracellular domain (aa 45-213) comprises the amino acid sequence of:

```
                                        (SEQ ID NO: 1226)
NFMYSKTVKRLSKLREYQQYHPSLTCVMEGKDIEDWSCCPTPWTSFQSSCY

FISTGMQSWTKSQKNCSVMGADLVVINTREEQDFIIQNLKRNSSYFLGLSD

PGGRRHWQWVDQTPYNENVTFWHSGEPNNLDERCAIINFRSSEEWGWNDIH

CHVPQKSICKMKKIYI.
```

In various embodiments, the present Clec4C binding agent comprises a targeting moiety capable of specific binding. In various embodiments, the Clec4C binding agent comprises a targeting moiety having an antigen recognition domain such as an antibody or derivatives thereof. In an embodiment, the Clec4C binding agent comprises a targeting moiety which is an antibody. In various embodiments, the antibody is a full-length multimeric protein that includes two heavy chains and two light chains. Each heavy chain includes one variable region (e.g., $V_H$) and at least three constant regions (e.g., $CH_1$, $CH_2$ and $CH_3$), and each light chain includes one variable region ($V_L$) and one constant region ($C_L$). The variable regions determine the specificity of the antibody. Each variable region comprises three hypervariable regions also known as complementarity determining regions (CDRs) flanked by four relatively conserved framework regions (FRs). The three CDRs, referred to as CDR1, CDR2, and CDR3, contribute to the antibody binding specificity. In some embodiments, the antibody is a chimeric antibody. In some embodiments, the antibody is a humanized antibody.

In some embodiments, the Clec4C binding agent comprises a targeting moiety which is an antibody derivative or format. In some embodiments, the present Clec4C binding agent comprises a targeting moiety which is a single-domain antibody, a recombinant heavy-chain-only antibody (VHH), a single-chain antibody (scFv), a shark heavy-chain-only antibody (VNAR), a microprotein (cysteine knot protein, knottin), a DARPin; a Tetranectin; an Affibody; a Transbody; an Anticalin; an AdNectin; an Affilin; an Affimer, a Microbody; an aptamer; an alterase; a plastic antibody; a phylomer; a stradobody; a maxibody; an evibody; a fynomer, an armadillo repeat protein, a Kunitz domain, an avimer, an atrimer, a probody, an immunobody, a triomab, a troybody; a pepbody; a vaccibody, a UniBody; a DuoBody, a Fv, a Fab, a Fab', a F(ab')$_2$, a peptide mimetic molecule, or a synthetic molecule, as described in U.S. Pat. Nos. or Patent Publication Nos. U.S. Pat. No. 7,417,130, US 2004/132094, U.S. Pat. No. 5,831,012, US 2004/023334, U.S. Pat. Nos. 7,250,297, 6,818,418, US 2004/209243, U.S. Pat. Nos. 7,838,629, 7,186,524, 6,004,746, 5,475,096, US 2004/146938, US 2004/157209, U.S. Pat. Nos. 6,994,982, 6,794, 144, US 2010/239633, U.S. Pat. No. 7,803,907, US 2010/119446, and/or U.S. Pat. No. 7,166,697, the contents of which are hereby incorporated by reference in their entireties. See also, Storz MAbs. 2011 May-June; 3(3): 310-317.

In some embodiments, the Clec4C binding agent comprises a targeting moiety which is a single-domain antibody, such as a VHH. The VHH may be derived from, for example, an organism that produces VHH antibody such as a camelid, a shark, or the VHH may be a designed VHH. VHHs are antibody-derived therapeutic proteins that contain the unique structural and functional properties of naturally-occurring heavy-chain antibodies. VHH technology is based on fully functional antibodies from camelids that lack light chains. These heavy-chain antibodies contain a single variable domain ($V_HH$) and two constant domains (CH2 and CH3).

In an embodiment, the Clec4C binding agent comprises a VHH. In some embodiments, the VHH is a humanized VHH or camelized VHH.

In some embodiments, the VHH comprises a fully human $V_H$ domain, e.g. a HUMABODY (Crescendo Biologics, Cambridge, UK). In some embodiments, fully human $V_H$ domain, e.g. a HUMABODY is monovalent, bivalent, or trivalent. In some embodiments, the fully human $V_H$ domain, e.g. a HUMABODY is mono- or multi-specific such as monospecific, bispecific, or trispecific. Illustrative fully human $V_H$ domains, e.g. a HUMABODIES are described in, for example, WO2016/113555 and WO2016/113557, the entire disclosure of which is incorporated by reference.

In some embodiments, the Clec4C binding agent comprises a targeting moiety which is a VHH comprising a single amino acid chain having four "framework regions" or FRs and three "complementary determining regions" or CDRs. As used herein, "framework region" or "FR" refers to a region in the variable domain which is located between the CDRs. As used herein, "complementary determining region" or "CDR" refers to variable regions in VHHs that contains the amino acid sequences capable of specifically binding to antigenic targets.

In various embodiments, the Clec4C binding agent comprises a VHH having a variable domain comprising at least one CDR1, CDR2, and/or CDR3 sequences. In various embodiments, the Clec4C binding agent comprises a VHH having a variable region comprising at least one FR1, FR2, FR3, and FR4 sequences.

```
In some embodiments, a human Clec4C
CDR1 sequence is selected from:
                                    (SEQ ID NO: 1227)
GSTFRHHAMA, (SEQ ID NO: 1228)
GSTFRHHALA, (SEQ ID NO: 1229)
GSTFKHHAMA, (SEQ ID NO: 1230)
GNNFEHYAVA, (SEQ ID NO: 1231)
GDTFSMYAMG, (SEQ ID NO: 1232)
GDTFSMYTMG, (SEQ ID NO: 1233)
GNTFSMYAMG, (SEQ ID NO: 1234)
TDTFSSLAMA, (SEQ ID NO: 1235)
GRTFSNYAMG, (SEQ ID NO: 1236)
GRTFSDYAMG, (SEQ ID NO: 1237)
GRTFSGYAMG, (SEQ ID NO: 1238)
GRTFTGYAMG, (SEQ ID NO: 1239)
GLTFGRYAMG, (SEQ ID NO: 1240)
GFTFDGYAIG, (SEQ ID NO: 1241)
GFTFSDYAVG, (SEQ ID NO: 1242)
GSTFSDYAVG, (SEQ ID NO: 1243)
GRTFINYAMG, (SEQ ID NO: 1244)
GRTFSNYAMG, (SEQ ID NO: 1245)
GDTFSNYAMG, (SEQ ID NO: 1246)
ERTFSNYAMG, (SEQ ID NO: 1247)
VFTLNNFIMS, (SEQ ID NO: 1248)
GRTFSTYAMG, (SEQ ID NO: 1249)
GRNLAYYVMG,
```

-continued

```
                                    (SEQ ID NO: 1250)
GFDFSDYVMY, (SEQ ID NO: 1251)
GRSISNYNMG, (SEQ ID NO: 1252)
GRIFSINAMG, (SEQ ID NO: 1253)
GRTFSSYAMG, (SEQ ID NO: 1254)
GRTFSSLAMG, (SEQ ID NO: 1255)
ERTFTNYAMG, (SEQ ID NO: 1256)
GRTFTNYAMG, (SEQ ID NO: 1257)
ERTFTNYAMA, (SEQ ID NO: 1258)
GRIFSNSAMG, (SEQ ID NO: 1259)
GREISSPAMG, (SEQ ID NO: 1260)
GRDFANDAVA, (SEQ ID NO: 1261)
GRTFSNYAMG, (SEQ ID NO: 1262)
GDTFSMYAMG, (SEQ ID NO: 1263)
GRDFANDAVA, (SEQ ID NO: 1264)
HHAMA, (SEQ ID NO: 1265)
HHALA, (SEQ ID NO: 1266)
HYAVA, (SEQ ID NO: 1267)
MYAMG, (SEQ ID NO: 1268)
MYTMG, (SEQ ID NO: 1269)
SLAMA, (SEQ ID NO: 1270)
NYAMG, (SEQ ID NO: 1271)
DYAMG, (SEQ ID NO: 1272)
GYAMG, (SEQ ID NO: 1273)
RYAMG, (SEQ ID NO: 1274)
GYAIG, (SEQ ID NO: 1275)
DYAVG, (SEQ ID NO: 1276)
NFIMS,
```

TYAMG, (SEQ ID NO: 1277)

YYVMG, (SEQ ID NO: 1278)

DYVMY, (SEQ ID NO: 1279)

NYNMG, (SEQ ID NO: 1280)

INAMG, (SEQ ID NO: 1281)

SYAMG, (SEQ ID NO: 1282)

SLAMG, (SEQ ID NO: 1283)

NYAMA, (SEQ ID NO: 1284)

NSAMG, (SEQ ID NO: 1285)

SPAMG, (SEQ ID NO: 1286)

NDAVA, and (SEQ ID NO: 1287)

DYVMY. (SEQ ID NO: 1288)

In some embodiments, a human Clec4C CDR2 sequence is selected from:

AINDHGTKTR, (SEQ ID NO: 1289)

AINDHGDRTK, (SEQ ID NO: 1290)

AINNHGTKTR, (SEQ ID NO: 1291)

AIRDYGDRTR, (SEQ ID NO: 1292)

AISRSGGSTD, (SEQ ID NO: 1293)

AISRSGGSTN, (SEQ ID NO: 1294)

AISRSGSSTN, (SEQ ID NO: 1295)

AISWSGASTV, (SEQ ID NO: 1296)

AISWSGDSTV, (SEQ ID NO: 1297)

TISVSGSSTD, (SEQ ID NO: 1298)

TISKSGSSTD, (SEQ ID NO: 1299)

TISTSGSSTY, (SEQ ID NO: 1300)

RISRSGNSTG, (SEQ ID NO: 1301)

RISRSGDSTG, (SEQ ID NO: 1302)

RISRSGDNTG, (SEQ ID NO: 1303)

CINKSDGLTY, (SEQ ID NO: 1304)

RITRLGNGPY, (SEQ ID NO: 1305)

AISTSGSNTY, (SEQ ID NO: 1306)

AISTSGGSTA, (SEQ ID NO: 1307)

AISRSAGSTY, (SEQ ID NO: 1308)

AISTSGGTTD, (SEQ ID NO: 1309)

DINMVGITD, (SEQ ID NO: 1310)

AIATNGGTTY, (SEQ ID NO: 1311)

TLTRGGDDTY, (SEQ ID NO: 1312)

SINASGVRTY, (SEQ ID NO: 1313)

SIRWDGDSTY, (SEQ ID NO: 1314)

VISRSGISN, (SEQ ID NO: 1315)

VISWRNNTY, (SEQ ID NO: 1316)

AINWSGDSTY, (SEQ ID NO: 1317)

AISRSGSSTS, (SEQ ID NO: 1318)

TISRSGSMPY, (SEQ ID NO: 1319)

AVEWSSGSTF, (SEQ ID NO: 1320)

TISRSGSSTF, (SEQ ID NO: 1321)

AISENSSILY, (SEQ ID NO: 1322)

YISRTGGSTK, (SEQ ID NO: 1323)

TINWSSGATL, (SEQ ID NO: 1324)

GIGSNNGTL, (SEQ ID NO: 1325)

AINDHGTKTRYSDSVRG, (SEQ ID NO: 1326)

AINDHGDRTKYLDSVRG, (SEQ ID NO: 1327)

AINNHGTKTRYSDSVRG, (SEQ ID NO: 1328)

AINDHGDRTKYTDSVRG, (SEQ ID NO: 1329)

AINDHGDRTKYSDSVRG, (SEQ ID NO: 1330)

AIRDYGDRTRYDDSVKG, (SEQ ID NO: 1331)

AIRDYGDRTRYADSVKG, (SEQ ID NO: 1332)

AISRSGGSTDYRDSVKG, (SEQ ID NO: 1333)

AISRSGGSTNYRDSVKG, (SEQ ID NO: 1334)

AISRSGSSTNYRDSVKG, (SEQ ID NO: 1335)

AISWSGASTVYGDSVKG, (SEQ ID NO: 1336)

AISWSGDSTVYGDSVKG, (SEQ ID NO: 1337)

TISVSGSSTDYADSVKG, (SEQ ID NO: 1338)

TISKSGSSTDYADSAKG, (SEQ ID NO: 1339)

TISTSGSSTYYADSVKG, (SEQ ID NO: 1340)

RISRSGNSTGYADSVKG, (SEQ ID NO: 1341)

RISRSGDSTGYADSVKG, (SEQ ID NO: 1342)

RISRSGDNTGYADSVKG, (SEQ ID NO: 1343)

CINKSDGLTYYEDSVKG, (SEQ ID NO: 1344)

RITRLGNGPYYSASVKG, (SEQ ID NO: 1345)

AISTSGSNTYLADSLKA, (SEQ ID NO: 1346)

AISTSGGSTAYADSVKG, (SEQ ID NO: 1347)

AISRSAGSTYHVDSVKG, (SEQ ID NO: 1348)

AISTSGGTTDYVDSVKG, (SEQ ID NO: 1349)

DINMVGITDYSDPVKG, (SEQ ID NO: 1350)

AIATNGGTTYYVDSVKG, (SEQ ID NO: 1351)

TLTRGGDDTYCADSVKG, (SEQ ID NO: 1352)

SINASGVRTYYVDALKG, (SEQ ID NO: 1353)

SIRWDGDSTYYADSVKG, (SEQ ID NO: 1354)

VISRSGISNYVDSVKG, (SEQ ID NO: 1355)

VISWRNNTYYADSVKG, (SEQ ID NO: 1356)

AINWSGDSTYYSDSMKG, (SEQ ID NO: 1357)

AISRSGSSTSYADSVKG, (SEQ ID NO: 1358)

TISRSGSMPYYADSVKG, (SEQ ID NO: 1359)

AVEWSSGSTFYTDSVKG, (SEQ ID NO: 1360)

TISRSGSSTFYAESVKG, (SEQ ID NO: 1361)

AISENSSILYYTASVKG, (SEQ ID NO: 1362)

YISRTGGSTKYENSVKG, (SEQ ID NO: 1363)

TINWSSGATLTADSVKG, (SEQ ID NO: 1364)
and

GIGSNNGTLTADSVKG. (SEQ ID NO: 1365)

In some embodiments, a human Clec4C CDR3 sequence is selected from:

GPLVDYLETVPVVYTY, (SEQ ID NO: 1366)

GPLVDYLETTPLVYTY, (SEQ ID NO: 1367)

GPLNDYLEVTPLVYTY, (SEQ ID NO: 1368)

RLTFSTTTAYTGELQYPY, (SEQ ID NO: 1369)

RLTFSTTTYTGELQYPY, (SEQ ID NO: 1370)

RLTFSTTDAYTGKLQYPY, (SEQ ID NO: 1371)

DLDGRTWHGDDLEYDY, (SEQ ID NO: 1372)

RLSFDNTALYTSANRYSY, (SEQ ID NO: 1373)

RLSFDNTAFYTSAIRYSD, (SEQ ID NO: 1374)

RLSFDNTAFYTSAIRYSY, (SEQ ID NO: 1375)

TTSWLPGHNANVYDY, (SEQ ID NO: 1376)

GTSWVPGHNANAYDY, (SEQ ID NO: 1377)

AWECDYAPADFGS, (SEQ ID NO: 1378)

GRTLASTHDTKTSPQTYDY, (SEQ ID NO: 1379)

RLSFDDSAYYTSTLRYAY, (SEQ ID NO: 1380)

RLSFSGSSYYQGPLQYPY, (SEQ ID NO: 1381)

RLTFNLIDYYTAETRYTY, (SEQ ID NO: 1382)

RLDFSSTDLYTTAPRYPY,
(SEQ ID NO: 1383)

GRPIGLYYPSPRIRDYND,
(SEQ ID NO: 1384)

RLSFGSGYYTNKLNYAY,
(SEQ ID NO: 1385)

RLAVLSSNTYCSGLWDY,
(SEQ ID NO: 1386)

VGQAPMYFGVDF,
(SEQ ID NO: 1387)

TVSSFDESKNPRWYPY,
(SEQ ID NO: 1388)

DVLLTFNKREDS,
(SEQ ID NO: 1389)

AGLGAVVAGMSDYDY,
(SEQ ID NO: 1390)

DASGYGSAWPDRYDY,
(SEQ ID NO: 1391)

APLVLKTTPGAYNY,
(SEQ ID NO: 1392)

NVLVTTTRLDQYDS,
(SEQ ID NO: 1393)

DHTGKLVFSKTSDY,
(SEQ ID NO: 1394)

RPLVPSEDPDNYNY,
(SEQ ID NO: 1395)

YGSTTIRTTTRPTK,
(SEQ ID NO: 1396)

HYNGVYQDSQSYDY,
(SEQ ID NO: 1397)

GATGVFRIARAYSY,
and
(SEQ ID NO: 1398)

GPTFFRIARAYPY.
(SEQ ID NO: 1399)

In various illustrative embodiments, a human Clec4C binding agent comprises an amino acid sequence selected from the following sequences:

1CL21:
(SEQ ID NO: 1400)
QVQLQESGGGLVRPGGSLRLSCVGSGSTFRHHAMAWFRQTTGKEREFVSAINDHGTKTRYSDSVRGRFTISRD
NDENMVYLQMDNLRPEDTAVYSCAAGPLVDYLETVPVVYTYWGQGTQVTVSS;

1CL25:
(SEQ ID NO: 1401)
QVQLQESGGGLVQPGGSLRLSCAASGSTFRHHAMAWFRQTPGKEREFVSAINDHGDRTKYLDSVRGRFTISRD
NTDNMVYLLMSDLRPEDTAVYSCAAGPLVDYLETTPLVYTYWGQGTQVTVSS;

1CL48:
(SEQ ID NO: 1402)
QVQLQESGGGLVQPGGSLRLSCVGSGSTFRHHAMAWFRQTAGKEREFVSAINNHGTKTRYSDSVRGRFTISRD
NDENMVYLQMDNLRPEDTAVYSCAAGPLVDYLETVPVVYTYWGQGTQVTVSS;

1CL72:
(SEQ ID NO: 1403)
QVQLQESGGGLVQPGESLKLSCAGSGSTFRHHAMAWFRQXPGKEREFVSAINDHGDRTKYLDSVRGRFTISRD
NTNNMVYLQMSDLRPEDTANYSCAAGPLVDYLETTPLVYTYWGQGTQVTVSS;

2CL4:
(SEQ ID NO: 1404)
QVQLQESGGGLVQPGGSLRISCAGSGSTFRHHAMAWFRQTAGKEREFVSAINDHGTKTRYSDSVRGRFTISRD
NDENMVYLQMDNLRSEDTANYTCAAGPLVDYLETVPVVYTYWGQGTQVTVSS;

2CL8:
(SEQ ID NO: 1405)
QVQLQESGGGLVQPGGSLKLSCAGSGSTFRHHALAWFRQTAEKEREFVSAINDHGTKTRYSDSVRGRFTISRD
NDGNMVYLQMDNLRPEDTAVYSCAAGPLVDYLETVPVVYTYWGQGTQVTVSS;

2CL41:
(SEQ ID NO: 1406)
QVQLQESGGGLVQAGGSLRLSCAASGSTFRHHAMAWFRQTPGKEREFVSAINDHGDRTKYLDSVRGRFTISRD
NTDNMVYLQMSDLRTEDTAVYTCAAGPLVDYLETTPLVYTYWGQGTQVTVSS;

2CL72:
(SEQ ID NO: 1407)
QVQLQESGGGLVQPGGSLKLSCAASGSTFRHHAMAWFRQTPGKEREFVSAINDHGDRTKYLDSVRGRFTISRD
NTDNMVYLQMSDLRPEDTAVYSCAAGPLVDYLETTPLVYTYWGQGTQVTVSS;

2CL78:
(SEQ ID NO: 1408)
QVQLQESGGGVVQPGGSLKLSCAASGSTFRHHAMAWFRQTPGKEREFVSAINDHGDRTKYLDSVRGRFTISRD

DTDNMVYLQMSDLRTEDTAVYTCAAGPLVDYLETTPLVYTYWGQGTQVTVSS;

2CL87:
(SEQ ID NO: 1409)
QVQLQESGGGLVQPGGSLRLSCAGSGSTFRHHAMAWFRQTPGKEREFVSAINDHGDRTKYTDSVRGRFTISRD

NTDNMVYLQMSDLRPEDTAVYSCAAGPLVDYLETTPLVYTYWGQGTQVTVSS;

2CL88:
(SEQ ID NO: 1410)
QVQLQESGGGLVQPGGSLKLSCTGSGSTFRHHAMAWFRQTPGKEREFVAAINDHGDRTKYLDSVRGRFTISRD

NTDNMVYLQMSDLRPEDTANYSCAAGPLVDYLETTPLVYTYWGQGTQVTVSS;

2CL90:
(SEQ ID NO: 1411)
QVQLQESGGGLVQAGGSLRLSCAASGSTFRHHAMAWFRQTPGKGREFVSAINDHGDRTKYLDSVRGRFTISRD

NTDNMVYLQMSDLRPEDTAVYSCAAGPLVDYLETTPLVYTYWGQGTQVTVSS;

2CL95:
(SEQ ID NO: 1412)
QVQLQESGGGLVQPGGSLKLSCAGSGSTFKHHAMAWFRHTPGKEREFVSAINDHGDRTKYSDSVRGRFTIARD

NTDNMVYLQMDDLLPEDTANYTCAAGPLVDYLETTPLVYTYWGQGTQVTVSS;

1CL54:
(SEQ ID NO: 1413)
QVQLQESGGGLAQAGASLRLSCAGSGNNFEHYAVAWFRQDAPGKERDFVAAIRDYGDRTRYDDSVKGRFTISR

DNAKSMVYLEMNNLKPKDAAVYYCAAGPLNDYLEVTPLVYTYWGQGTQVTVSS;

2CL52:
(SEQ ID NO: 1414)
QVQLQESGGGLAQAGASLRLSCAGSGNNFEHYAVAWFRQEAPGKERDFVAAIRDYGDRTRYADSVKGRFTISR

DNAKSMVYLEMNNLKPEDTAVYYCTAGPLNDYLEVTPLVYTYWGQGTQVTVSS;

1CL2:
(SEQ ID NO: 1415)
QVQLQESGGGLVQAGDSLRLSCAASGDTFSMYAMGWFRQAPGKEREFVAAISRSGGSTDYRDSVKGRFTISR

DNDLNAGYLQMNSLKPEDTAVYYCALRLTFSTTTAYTGELQYPYWGQGTQVTVSS;

1CL32:
(SEQ ID NO: 1416)
QVQLQESGGGLVQAGDSLRLSCAASGDTFSMYTMGWFRQAPGKEREFVAAISRSGGSTNYRDSVKGRFTISRD

NDLNAGYLQMNSLKPEDTAVYYCALRLTFSTTTAYTGELQYPYWGQGTQVTVSS;

2CL58:
(SEQ ID NO: 1417)
QVQLQESGGGLVQAGDSLRLSCAASGDTFSMYAMGWFRQAPGKEREFVAAISRSGSSTNYRDSVKGRFTISRD

NDLNAGYLQMNSLKPEDTAVYYCALRLTFSTTTTYTGELQYPYWGQGTQVTVSS;

2CL73:
(SEQ ID NO: 1418)
QVQLQESGGGLVQAGDSLRLSCAASGNTFSMYAMGWFRQAPGKEREFVAAISRSGGSTNYRDSVKGRFTISR

DNDLNAGYLQMNNLKPEDTAVYYCALRLTFSTTDAYTGKLQYPYWGQGTQVTVSS;

2CL43:
(SEQ ID NO: 1419)
QVQLQESGGGTVQPGESLRLSCEVSTDTFSSLAMAWFRQATGKDREFVAAISWSGASTVYGDSVKGRFTMTR

DHPKKMVYLQMDNLKPEDTAVYYCAGDLDGRTWHGDDLEYDYWGQGTQVTVSS;

2CL82:
(SEQ ID NO: 1420)
QVQLQESGGGLVQPGGSLRLSCEVSTDTFSSLAMAWFRQATGKEREFVAAISWSGASTVYGDSVKGRFTMTR

DHPKKMVYLQMDNLKPEDTAVYYCAGDLDGRTWHGDDLEYDYWGQGTQVTVSS;

-continued

2CL89:
(SEQ ID NO: 1421)
QVQLQESGGGTVQPGESLRLSCEVSTDTFSSLAMAWFRQATAKDREFVAAISWSGDSTVYGDSVKGRFTMTR
DHPKKMVYLQMDNLKPEDTAVYYCAGDLDGRTWHGDDLEYDYWGQGTQVTVSS;

2CL25:
(SEQ ID NO: 1422)
QVQLQESGGGSVQAGGSLRLSCAASGRTFSNYAMGXFRQTPGKEREFVATISVSGSSTDYADSVKGRFTISRD
NAKKTVYLQINSLKTEDTAVYYCAARLSFDNTALYTSANRYSYWGQGTQVTVSS;

2CL84:
(SEQ ID NO: 1423)
QVQLQESGGGSVQAGGSLRLSCAASGRTFSDYAMGWFRQAPGKEREFVATISKSGSSTDYADSAKGRFTISRD
NAKKTVYLQINSLKTEDTAVYYCAARLSFDNTAFYTSAIRYSDWGQGTQVTVSS;

2CL92:
(SEQ ID NO: 1424)
QVQLQESGGGSVQAGDSLRLSCAASGRTFSGYAMGWFRQAPGKEREFVATISTSGSSTYYADSVKGRFTISRD
NAKKSVYLQINSLKTEDAAVYYCAARLSFDNTAFYTSAIRYSYWGQGTQVTVSS;

2CL21:
(SEQ ID NO: 1425)
QVQLQESGGGLVQAGGSLRLSCAASGRTFTGYAMGWFRQVPGLEREFVARISRSGNSTGYADSVKGRFTVSR
DNAKSTMYLQMNSLKTEDTAVYYCAATTSWLPGHNANVYDYWGQGTQVTVSS;

2CL30:
(SEQ ID NO: 1426)
QVQLQESGGGSVQAGGSLRLSCAASGRTFSDYAMGWFRQVPGLEREFVARISRSGDSTGYADSVKGRFTVSR
DNAKNTVYLQMNSLKTEDTAVYYCAATTSWLPGHNANVYDYWGQGTQVTVSS;

2CL71:
(SEQ ID NO: 1427)
QVQLQESGGGLVQAGGSLRLSCAASGLTFGRYAMGWFRQVPGLEREFIARISRSGDNTGYADSVKGRFTVSRD
SAKSTVYLQMNSLKTEDTAVYYCAAGTSWVPGHNANAYDYWGQGTQVTVSS;

2CL7:
(SEQ ID NO: 1428)
QVQLQESGGGLVQAGDSLRLSCAPSGFTFDGYAIGWFRQAPGKEREKVACINKSDGLTYYEDSVKGRFTISSDT
AKNTIHLQMNSLKPDDTAVYYCAAAWECDYAPADFGSWGQGTQVTVSS;

2CL18:
(SEQ ID NO: 1429)
QVQLQESGGGLVQAGGSLRLSCAPSGFTFDGYAIGWFRQAPGKEREKVACINKSDGLTYYEDSVKGRFTISSDT
AKNTIHLQMNSLKPDDTAVYYCAAAWECDYAPADFGSWGQGTQVTVSS;

2CL26:
(SEQ ID NO: 1430)
QVQLQESGGGWVQPGDSLRLSCAASGFTFSDYAVGWFRQAPGKEREFVARITRLGNGPYYSASVKGRFTISRD
NARDMAYLKMDALTPEDTATYYCAAGRTLASTHDTKTSPQTYDYWGLGTQVTVSS;

2CL55:
(SEQ ID NO: 1431)
QVQLQESGGGWVQPGDSLRLSCAASGSTFSDYAVGWFRQAPGKEREFVARITRLGNGPYYSASVKGRFTISRD
NARDMAYLKMDALTPEDTATYYCAAGRTLASTHDTKTSPQTYDYWGQGTQVTVSS;

1CL47:
(SEQ ID NO: 1432)
QVQLQESGGGLVQAGGSRRLSCAASGRTFINYAMGWFRQAPGKEREFVAAISTSGSNTYLADSLKARFTISRDN
AKNTVYLQIRSLNPEDTAVYYCAARLSFDDSAYYTSTLRYAYWGQGTQVTVSS;

2CL59:
(SEQ ID NO: 1433)
QVQLQESGGGLVQPGDSLTLSCADSGRTFSNYAMGWFHQAPGKEREFVAAISTSGGSTAYADSVKGRFTISRD
NAKNTVYLQMNNLKPEDTAVYYCAARLSFSGSSYYQGPLQYPYWGQGTQVTVSS;

```
2CL16:
                                                  (SEQ ID NO: 1434)
QVQLQESGGGLVQPGGSLRLSCAASGDTFSNYAMGWFRQAPGKAREFVAAISRSAGSTYHVDSVKGRFTISRD

NAMNTVYLQMNSLQPEDTAHYYCAARLTFNLIDYYTAETRYTYWGQGTQVTVSS;

2CL91:
                                                  (SEQ ID NO: 1435)
QVQLQESGGGLVQAGDSLRLSCTASERTFSNYAMGWFRLAPGKERKFVAAISTSGGTTDYVDSVKGRFTISRD

NAKNTVYLQMNSLKPEDTAVYYCAARLDFSSTDLYTTAPRYPYWGQGTQVTVSS;

2CL15:
                                                  (SEQ ID NO: 1436)
QVQLQESGGGLVQPGGSVRLSCAASVFTLNNFIMSWVRQAPGKGLERVSDINMVGITDYSDPVKGRFTISRDNK

QNTVYLQGNTLKPEDTAVYFCAAGRPIGLYYPSPRIRDYNDWGQGTQVTVSS;

2CL81:
                                                  (SEQ ID NO: 1437)
QVQLQESGGGLVQAGDSLKLSCAASGRTFSTYAMGWFRQAPGKERDVVAAIATNGGTTYYVDSVKGRFTISRD

NAQNRVYLQMNSLKPEDTAIYYCAARLSFGSGYYTNKLNYAYWGQGTQVTVSS;

1CL81:
                                                  (SEQ ID NO: 1438)
QVQLQESGGGLVQAGNSLKLSCAASGRNLAYYVMGWFRQAPGREREPVATLTRGGDDTYCADSVKGRFTISS

DNAKNTVYLQMNNLKPEDTAIYTCAARLAVLSSNTYCSGLWDYWGQGTQVTVSS;

1CL56:
                                                  (SEQ ID NO: 1439)
QVQLQESGGGLVQPGGSLTLSCGASGFDFSDYVMYWLRQAPGKGLQWVSSINASGVRTYYVDALKGRFTISRD

NAKNTLYLQIDDLKPEDTGLYYCARVGQAPMYFGVDFWGNGTQVTVSS;

2CL40:
                                                  (SEQ ID NO: 1440)
QVQLQESGGGLVQTGGSLRVSCAASGRSISNYNMGWFRQPPGKEREIVGSIRWDGDSTYYADSVKGRFTISRD

NTKNTVYLQMNSLKSEDTADYYCAATVSSFDESKNPRWYPYWGQGTQVTVSS;

2CL65:
                                                  (SEQ ID NO: 1441)
QVQLQESGGGLVQPGGSLRLSCAASGRIFSINAMGWYRQAPGKQRELVAVISRSGISNYVDSVKGRFTISRDNA

KNTVYLQMNSLNPEDTADYYCNADVLLTFNKREDSWGQGTQVTVSS;

2CL57:
                                                  (SEQ ID NO: 1442)
QVQLQESGGGLVQAGGSLKLSCAASGRTFSSYAMGWFRQAPGKERDFVAVISWRNNTYYADSVKGRFTISRD

NAKNTVHLQMNSLKSEDTAVYYCAAAGLGAVVAGMSDYDYWGQGTQVTVSS;

2CL56:
                                                  (SEQ ID NO: 1443)
QVQLQESGGGSVQAGDSLTLSCIASGRTFSSLAMGWFRQAPGKEREFVAAINWSGDSTYYSDSMKGRLTMSR

DNAKNTVFLQMNSLEPEDTAVYVCAADASGYGSAWPDRYDYWGQGTQVTVSS;

2CL66:
                                                  (SEQ ID NO: 1444)
QVQLQESGGGLVQAGGSLRLSCAASERTFTNYAMGWFRQGPGKDRAFVAAISRSGSSTSYADSVKGRFTISRD

NAENILYLQMNSLKPEDTAVYYCAAAPLVLKTTPGAYNYWGQGTQVTVSS;

2CL34:
                                                  (SEQ ID NO: 1445)
QVQLQESGGGLVQAGGSLRLSCAASGRTFTNYAMGWFRQAPGKEREFVATISRSGSMPYYADSVKGRFTISRD

NAKNMVYLQMNSLKPEDTAVYYCAANVLVTTTRLDQYDSWGQGTQVTVSS;

2CL46:
                                                  (SEQ ID NO: 1446)
QVQLQESGGGLVQAGGSLRLSCAVSGRTFSSYAMGWFRQARGKEREFVAAVEWSSGSTFYTDSVKGRFAISR

DIAKNTVYLQMNSLKPEDTAVYYCAGDHTGKLVFSKTSDYWGQGTQVTVSS;
```

2CL29:
(SEQ ID NO: 1447)
QVQLQESGGGLVQPGDSLRLSCTASERTFTNYAMAWFRQAPGKERDVLATISRSGSSTFYAESVKGRFTISRDN

TKNTVYLQMNSLEPEDTAVYYCAARPLVPSEDPDNYNYWGQGTQVTVSS;

1CL88:
(SEQ ID NO: 1448)
QVQLQESGGGLVQAGGSLRLSCAASGRIFSNSAMGWFRQVLGKEREFVAAISENSSILYYTASVKGRFTISRDN

DKNTVYLQMTSLKAEDTAVYYCAGYGSTTIRTTTRPTKWGQGTQVTVSS;

2CL68:
(SEQ ID NO: 1449)
QVQLQESGGGLVQAGDSLRLSCVASGRTLSNYGMGWFRQAPGKGREFVAYISRTGGSTKYENSVKGRFIISRD

TAKNTIYLQMNSLQGEDTAVYYCAFHYNGVYQDSQSYDYWGXGTQVTVSS;

1CL82:
(SEQ ID NO: 1450)
QVQLQESGGGSVQAGDSLRLSCVAPGREISSPAMGWFRQAPGKEREFVATINWSSGATLTADSVKGRFTIFKD

VEKNTVYLQMNSLRPEDTAVYSCAAGATGVFRIARAYSYWGQGTQVTVSS;
and

2CL49:
(SEQ ID NO: 1451)
QVQLQESGGGLMQAGDSLRLSCTVSGRDFANDAVAWFRXPPGKEREFVVGIGSNNGTLTADSVKGRSTIWRD

NIKNTVYLQMSRLTPDDTAVYYCASGPTFFRIARAYPYWGQGTQVTVSS.

In some embodiments, an "X" at any position of amino acid sequences SEQ ID NOs: 1400-1451 indicates the amino acid at that position is any one of the 20 naturally occurring amino acids can be grouped into the following six standard amino acid groups: (1) hydrophobic: Met, Ala, Val, Leu, Ile; (2) neutral hydrophilic: Cys, Ser, Thr; Asn, Gln; (3) acidic: Asp, Glu; (4) basic: His, Lys, Arg; (5) residues that influence chain orientation: Gly, Pro; and (6) aromatic: Trp, Tyr, Phe.

In various illustrative embodiments, a human Clec4C binding agent comprises an amino acid sequence selected from the following sequences:

1CL72 revised:
(SEQ ID NO: 1452)
QVQLQESGGGLVQPGESLKLSCAGSGSTFRHHAMAWFRQTPGKEREFVSAI

NDHGDRTKYLDSVRGRFTISRDNTNNMVYLQMSDLRPEDTANYSCAAGPLV

DYLETTPLVYTYWGQGTQVTVSS;

2OL25 revised:
(SEQ ID NO: 1453)
QVQLQESGGGSVQAGGSLRLSCAASGRTFSNYAMGWFRQTPGKEREFVATI

SVSGSSTDYADSVKGRFTISRDNAKKTVYLQINSLKTEDTAVYYCAARLSF

DNTALYTSANRYSYWGQGTQVTVSS;

2OL68 revised:
(SEQ ID NO: 1454)
QVQLQESGGGLVQAGDSLRLSCVASGRTLSNYGMGWFRQAPGKGREFVAYI

SRTGGSTKYENSVKGRFIISRDTAKNTIYLQMNSLQGEDTAVYYCAFHYNG

VYQDSQSYDYWGQGTQVTVSS;

2CL49 revised:
(SEQ ID NO: 1455)
QVQLQESGGGLMQAGDSLRLSCTVSGRDFANDAVAWFRQPPGKEREFVVGI

GSNNGTLTADSVKGRSTIWRDNIKNTVYLQMSRLTPDDTAVYYCASGPTFF

RIARAYPYWGQGTQVTVSS.

In various illustrative embodiments, the Clec4C binding agent comprises an amino acid sequence selected from SEQ ID NO: 1400 to SEQ ID NO: 1455 with a terminal histidine tag sequence (i.e., HHHHHH; SEQ ID NO: 327).

In some embodiments, the Clec4C binding agent comprises an amino acid sequence selected from SEQ ID NO: 1400 to SEQ ID NO: 1455 (provided above) with a HA tag (i.e., YPYDVPDYGS; SEQ ID NO: 328).

In some embodiments, the Clec4C binding agent comprises an amino acid sequence selected from SEQ ID NO: 1400 to SEQ ID NO: 1455 (provided above) with an AAA linker.

In some embodiments, the Clec4C binding agent comprises an amino acid sequence selected from SEQ ID NO: 1400 to SEQ ID NO: 1455 (provided above) with an AAA linker, HA tag, and terminal histidine tag sequence (i.e., AAAYPYDVPDYGSHHHHHH; SEQ ID NO: 329).

In various embodiments, the Clec4C binding agent comprises an amino acid sequence selected from any one of the sequences listed in Table 9 or a sequence of about 90%, or about 93%, or about 95%, or about 97%, or about 98%, or about 99% identity thereto. In some embodiments, the human Clec4C CDR1 sequence is selected from any one of the CDR1 sequences listed in Table 9. In some embodiments, the human Clec4C CDR2 sequence is selected from any one of the CDR2 sequences listed in Table 9. In some embodiments, the human Clec4C CDR3 sequence is selected from any one of the CDR3 sequences listed in Table 9.

In various embodiments, the present technology contemplates the use of any natural or synthetic analogs, mutants, variants, alleles, homologs and orthologs (herein collectively referred to as "analogs") of the Clec4C binding agent described herein. In various embodiments, the amino acid sequence of the Clec4C binding agent further includes an amino acid analog, an amino acid derivative, or other non-classical amino acids.

In various embodiments, the Clec4C binding agent comprises a sequence that is at least 60% identical to any one of the Clec4C sequences disclosed herein. For example, the Clec4C binding agent may comprise a sequence that is at least about 60%, at least about 61%, at least about 62%, at least about 63%, at least about 64%, at least about 65%, at least about 66%, at least about 67%, at least about 68%, at least about 69%, at least about 70%, at least about 71%, at least about 72%, at least about 73%, at least about 74%, at least about 75%, at least about 76%, at least about 77%, at least about 78%, at least about 79%, at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or 100% identical to any of the Clec4C sequences disclosed herein (e.g., about 60%, or about 61%, or about 62%, or about 63%, or about 64%, or about 65%, or about 66%, or about 67%, or about 68%, or about 69%, or about 70%, or about 71%, or about 72%, or about 73%, or about 74%, or about 75%, or about 76%, or about 77%, or about 78%, or about 79%, or about 80%, or about 81%, or about 82%, or about 83%, or about 84%, or about 85%, or about 86%, or about 87%, or about 88%, or about 89%, or about 90%, or about 91%, or about 92%, or about 93%, or about 94%, or about 95%, or about 96%, or about 97%, or about 98%, about 99% or about 100% sequence identity to any one of the Clec4C sequences disclosed herein).

In various embodiments, the Clec4C binding agent comprising an amino acid sequence having one or more amino acid mutations with respect to any targeting moiety sequence that is known to recognize and bind to Clec4C. In various embodiments, the Clec4C binding agent comprises an amino acid sequence having one, or two, or three, or four, or five, or six, or seen, or eight, or nine, or ten, or fifteen, twenty, thirty, forty, or fifty amino acid mutations with respect to any targeting moiety sequence that is known to recognize and bind to Clec4C. In some embodiments, the one or more amino acid mutations may be independently selected from substitutions, insertions, deletions, and truncations.

In some embodiments, the amino acid mutations are amino acid substitutions, and may include conservative and/or non-conservative substitutions.

"Conservative substitutions" may be made, for instance, on the basis of similarity in polarity, charge, size, solubility, hydrophobicity, hydrophilicity, and/or the amphipathic nature of the amino acid residues involved. The 20 naturally occurring amino acids can be grouped into the following six standard amino acid groups: (1) hydrophobic: Met, Ala, Val, Leu, Ile; (2) neutral hydrophilic: Cys, Ser, Thr; Asn, Gln; (3) acidic: Asp, Glu; (4) basic: His, Lys, Arg; (5) residues that influence chain orientation: Gly, Pro; and (6) aromatic: Trp, Tyr, Phe.

As used herein, "conservative substitutions" are defined as exchanges of an amino acid by another amino acid listed within the same group of the six standard amino acid groups shown above. For example, the exchange of Asp by Glu retains one negative charge in the so modified polypeptide. In addition, glycine and proline may be substituted for one another based on their ability to disrupt α-helices.

As used herein, "non-conservative substitutions" are defined as exchanges of an amino acid by another amino acid listed in a different group of the six standard amino acid groups (1) to (6) shown above.

In various embodiments, the substitutions may also include non-classical amino acids. Illustrative non-classical amino acids include, but are not limited to, selenocysteine, pyrrolysine, N-formylmethionine β-alanine, GABA and δ-Aminolevulinic acid, 4-aminobenzoic acid (PABA), D-isomers of the common amino acids, 2,4-diaminobutyric acid, α-amino isobutyric acid, 4-aminobutyric acid, Abu, 2-amino butyric acid, γ-Abu, ε-Ahx, 6-amino hexanoic acid, Aib, 2-amino isobutyric acid, 3-amino propionic acid, ornithine, norleucine, norvaline, hydroxyproline, sarcosme, citrulline, homocitrulline, cysteic acid, t-butylglycine, t-butylalanine, phenylglycine, cyclohexylalanine, β-alanine, fluoro-amino acids, designer amino acids such as β methyl amino acids, C α-methyl amino acids, N α-methyl amino acids, and amino acid analogs in general.

In various embodiments, the amino acid mutation may be in the CDRs of the targeting moiety (e.g., the CDR1, CDR2 or CDR3 regions). In another embodiment, amino acid alteration may be in the framework regions (FRs) of the targeting moiety (e.g., the FR1, FR2, FR3, or FR4 regions).

Modification of the amino acid sequences may be achieved using any known technique in the art e.g., site-directed mutagenesis or PCR based mutagenesis. Such techniques are described, for example, in Sambrook et al., Molecular Cloning: A Laboratory Manual, Cold Spring Harbor Press, Plainview, N.Y., 1989 and Ausubel et al., Current Protocols in Molecular Biology, John Wiley & Sons, New York, N.Y., 1989.

In various embodiments, the mutations do not substantially reduce the Clec4C's capability to specifically recognize and bind to Clec4C. In various embodiments, the mutations do not substantially reduce the Clec4C's capability to specifically bind to Clec4C and without functionally modulating (e.g., partially or fully neutralizing) Clec4C.

In various embodiments, the binding affinity of the Clec4C binding agent for the full-length and/or mature forms and/or isoforms and/or splice variants and/or fragments and/or monomeric and/or dimeric forms and/or any other naturally occurring or synthetic analogs, variants, or mutants of Clec4C may be described by the equilibrium dissociation constant ($K_D$). In various embodiments, the present Clec4C binding agent comprises a targeting moiety that binds to the full-length and/or mature forms and/or isoforms and/or splice variants and/or fragments and/or any other naturally occurring or synthetic analogs, variants, or mutants (including monomeric and/or dimeric forms) of Clec4C with a $K_D$ of less than about 1 µM, about 900 nM, about 800 nM, about 700 nM, about 600 nM, about 500 nM, about 400 nM, about 300 nM, about 200 nM, about 100 nM, about 90 nM, about 80 nM, about 70 nM, about 60 nM, about 50 nM, about 40 nM, about 30 nM, about 20 nM, about 10 nM, or about 5 nM, or about 1 nM.

In various embodiments, the Clec4C binding agent binds but does not functionally modulate the antigen of interest, i.e., Clec4C. For instance, in various embodiments, the Clec4C binding agent simply targets the antigen but does not substantially functionally modulate (e.g. substantially inhibit, reduce or neutralize) a biological effect that the antigen has. In various embodiments, the Clec4C binding agent binds an epitope that is physically separate from an antigen site that is important for its biological activity (e.g. an antigen's active site).

Such binding without significant function modulation finds use in various embodiments of the present invention, including methods in which the present Clec4C binding agent is used to directly or indirectly recruit active immune cells to a site of need via an effector antigen. For example, in various embodiments, the present Clec4C binding agent may be used to directly or indirectly recruit dendritic cells via Clec4C to a tumor cell in a method of reducing or eliminating a tumor (e.g. the Clec4C binding agent may comprise a targeting moiety having an anti-Clec4C antigen recognition domain and a targeting moiety having a recognition domain (e.g. antigen recognition domain) directed against a tumor antigen or receptor). In such embodiments, it is desirable to directly or indirectly recruit dendritic cells but not to functionally modulate or neutralize the Clec4C activity. In these embodiments, Clec4C signaling is an important piece of the tumor reducing or eliminating effect.

In other embodiments, the Clec4C binding agent binds but functionally modulates the antigen of interest, i.e., Clec4C. For instance, in various embodiments, the Clec4C binding agent targets the antigen, i.e., Clec4C, and functionally modulates (e.g. inhibit, reduce or neutralize) a biological effect that the antigen has. Such binding along with functional modulation may find use in various embodiments of the present invention including methods in which the present chimeric protein or chimeric protein complex is used to directly or indirectly recruit active immune cells to a site of need via an effector antigen.

In some embodiments, the Clec4C binding agent enhances antigen-presentation by dendritic cells. For example, in various embodiments, the present Clec4C binding agent directly or indirectly recruits dendritic cells via Clec4C to a tumor cell, where tumor antigens are subsequently endocytosed and presented on the dendritic cell for induction of potent humoral and cytotoxic T cell responses.

In embodiments (for example, related to treating autoimmune or neurodegenerative disease), the Clec4C binding agent comprises a targeting moiety that binds and neutralizes the antigen of interest, i.e., Clec4C. For instance, in various embodiments, the present methods may inhibit or reduce Clec4C signaling or expression, e.g. to cause a reduction in an immune response.

In embodiments, e.g. relating to autoimmunity, the Clec4C binding agent delivers a tolerogenic signal to reduce an immune response.

Therapeutic Agents Comprising the Present Clec4C Binding Agents

Chimeras and Fusions with Signaling Agents

In various embodiments, the Clec4C binding agent of the present invention is part of a chimera or fusion with one or more signaling agents. Accordingly, the present invention provides for chimeric or fusion proteins that include, for example, a targeting moiety against Clec4C and one or more signaling agents.

In various embodiments, the signaling agent is modified to have reduced affinity or activity for one or more of its receptors, which allows for attenuation of activity (inclusive of agonism or antagonism) and/or prevents non-specific signaling or undesirable sequestration of the chimeric or fusion protein. In various embodiments, the signaling agent is antagonistic in its wild type form and bears one or more mutations that attenuate its antagonistic activity. In various embodiments, the signaling agent is antagonistic due to one or more mutations, e.g. an agonistic signaling agent is converted to an antagonistic signaling agent and, such a converted signaling agent, optionally, also bears one or more mutations that attenuate its antagonistic activity (e.g. as described in WO 2015/007520, the entire contents of which are hereby incorporated by reference).

Accordingly, in various embodiments, the signaling agent is a modified (e.g. mutant) form of the signaling agent having one or more mutations. In various embodiments, the modifications (e.g. mutations) allow for the modified signaling agent to have one or more of attenuated activity such as one or more of reduced binding affinity, reduced endogenous activity, and reduced specific bioactivity relative to unmodified or unmutated, i.e. the wild type form of the signaling agent (e.g. comparing the same signaling agent in a wild type form versus a modified or mutant form). In some embodiments, the mutations which attenuate or reduce binding or affinity include those mutations which substantially reduce or ablate binding or activity. In some embodiments, the mutations which attenuate or reduce binding or affinity are different than those mutations which substantially reduce or ablate binding or activity. Consequentially, in various embodiments, the mutations allow for the signaling agent to have improved safety, e.g. reduced systemic toxicity, reduced side effects, and reduced off-target effects relative to unmutated, i.e. wild type, signaling agent (e.g. comparing the same signaling agent in a wild type form versus a modified (e.g. mutant) form).

As described herein, the agent may have improved safety due to one of more modifications, e.g. mutations. In various embodiments, improved safety means that the present chimeric protein or chimeric protein complex provides lower toxicity (e.g. systemic toxicity and/or tissue/organ-associated toxicities); and/or lessened or substantially eliminated side effects; and/or increased tolerability, lessened or substantially eliminated adverse events; and/or reduced or substantially eliminated off-target effects; and/or an increased therapeutic window.

In various embodiments, the signaling agent is modified to have one or more mutations that reduce its binding affinity or activity for one or more of its receptors. In some embodiments, the signaling agent is modified to have one or more mutations that substantially reduce or ablate binding affinity or activity for the receptors. In some embodiments, the activity provided by the wild type signaling agent is agonism at the receptor (e.g. activation of a cellular effect at a site of therapy). For example, the wild type signaling agent may activate its receptor. In such embodiments, the mutations result in the modified signaling agent to have reduced or ablated activating activity at the receptor. For example, the mutations may result in the modified signaling agent to deliver a reduced activating signal to a target cell or the activating signal could be ablated. In some embodiments, the activity provided by the wild type signaling agent is antagonism at the receptor (e.g. blocking or dampening of a cellular effect at a site of therapy). For example, the wild type signaling agent may antagonize or inhibit the receptor. In these embodiments, the mutations result in the modified signaling agent to have a reduced or ablated antagonizing activity at the receptor. For example, the mutations may result in the modified signaling agent to deliver a reduced inhibitory signal to a target cell or the inhibitory signal could be ablated. In various embodiments, the signaling agent is antagonistic due to one or more mutations, e.g. an agonistic signaling agent is converted to an antagonistic signaling agent (e.g. as described in WO 2015/007520, the entire contents of which are hereby incorporated by reference) and, such a converted signaling agent, optionally, also bears one or more mutations that reduce its binding affinity or activity for one or more of its receptors or that substantially reduce or ablate binding affinity or activity for one or more of its receptors.

In some embodiments, the reduced affinity or activity at the receptor is restorable by attachment with one or more of the targeting moieties as described herein (e.g., targeting moiety against Clec4C or any other targeting moiety described herein). In other embodiments, the reduced affinity or activity at the receptor is not substantially restorable by the activity of one or more of the targeting moieties.

In various embodiments, the chimeric proteins or chimeric protein complexes of the present invention reduce off-target effects because their signaling agents have mutations that weaken or ablate binding affinity or activity at a receptor. In various embodiments, this reduction in side effects is observed relative with, for example, the wild type signaling agents. In various embodiments, the signaling agent is active on target cells because the targeting moiety(ies) compensates for the missing/insufficient binding (e.g., without limitation and/or avidity) required for substantial activation. In various embodiments, the modified signaling agent is substantially inactive en route to the site of therapeutic activity and has its effect substantially on specifically targeted cell types which greatly reduces undesired side effects.

In some embodiments, the signaling agent may include one or more mutations that attenuate or reduce binding or affinity for one receptor (i.e., a therapeutic receptor) and one or more mutations that substantially reduce or ablate binding or activity at a second receptor. In such embodiments, these mutations may be at the same or at different positions (i.e., the same mutation or multiple mutations). In some embodiments, the mutation(s) that reduce binding and/or activity at one receptor is different than the mutation(s) that substantially reduce or ablate at another receptor. In some embodiments, the mutation(s) that reduce binding and/or activity at one receptor is the same as the mutation(s) that substantially reduce or ablate at another receptor. In some embodiments, the present chimeric proteins or chimeric protein complexes have a modified signaling agent that has both mutations that attenuate binding and/or activity at a therapeutic receptor and therefore allow for a more controlled, on-target therapeutic effect (e.g. relative wild type signaling agent) and mutations that substantially reduce or ablate binding and/or activity at another receptor and therefore reduce side effects (e.g. relative to wild type signaling agent).

In some embodiments, the substantial reduction or ablation of binding or activity is not substantially restorable with a targeting moiety (e.g., a targeting moiety against Clec4C or any other targeting moiety described herein). In some embodiments, the substantial reduction or ablation of binding or activity is restorable with a targeting moiety. In various embodiments, substantially reducing or ablating binding or activity at a second receptor also may prevent deleterious effects that are mediated by the other receptor. Alternatively, or in addition, substantially reducing or ablating binding or activity at the other receptor causes the therapeutic effect to improve as there is a reduced or eliminated sequestration of the therapeutic chimeric proteins or chimeric protein complexes away from the site of therapeutic action. For instance, in some embodiments, this obviates the need of high doses of the present chimeric proteins or chimeric protein complexes that compensate for loss at the other receptor. Such ability to reduce dose further provides a lower likelihood of side effects.

In various embodiments, the modified signaling agent comprises one or more mutations that cause the signaling agent to have reduced, substantially reduced, or ablated affinity, e.g. binding (e.g. $K_D$) and/or activation (for instance, when the modified signaling agent is an agonist of its receptor, measurable as, for example, $K_A$ and/or $EC_{50}$) and/or inhibition (for instance, when the modified signaling agent is an antagonist of its receptor, measurable as, for example, $K_I$ and/or $IC_{50}$), for one or more of its receptors. In various embodiments, the reduced affinity at the signaling agent's receptor allows for attenuation of activity (inclusive of agonism or antagonism). In such embodiments, the modified signaling agent has about 1%, or about 3%, about 5%, about 10%, about 15%, about 20%, about 25%, about 30%, about 35%, about 40%, about 45%, about 50%, about 60%, about 65%, about 70%, about 75%, about 80%, about 85%, about 90%, about 95%, or about 10%-20%, about 20%-40%, about 50%, about 40%-60%, about 60%-80%, about 80%-100% of the affinity for the receptor relative to the wild type signaling agent. In some embodiments, the binding affinity is at least about 2-fold lower, about 3-fold lower, about 4-fold lower, about 5-fold lower, about 6-fold lower, about 7-fold lower, about 8-fold lower, about 9-fold lower, at least about 10-fold lower, at least about 15-fold lower, at least about 20-fold lower, at least about 25-fold lower, at least about 30-fold lower, at least about 35-fold lower, at least about 40-fold lower, at least about 45-fold lower, at least about 50-fold lower, at least about 100-fold lower, at least about 150-fold lower, or about 10-50-fold lower, about 50-100-fold lower, about 100-150-fold lower, about 150-200-fold lower, or more than 200-fold lower relative to the wild type signaling agent.

In embodiments, the chimeric protein or chimeric protein complex comprises a modified signaling agent having mutations that reduce binding at one receptor and substantially reduce or ablate binding at a second receptor, the attenuation or reduction in binding affinity of the modified signaling agent for one receptor is less than the substantial reduction or ablation in affinity for the other receptor. In some embodiments, the attenuation or reduction in binding affinity of the modified signaling agent for one receptor is less than the substantial reduction or ablation in affinity for the other receptor by about 1%, or about 3%, about 5%, about 10%, about 15%, about 20%, about 25%, about 30%, about 35%, about 40%, about 45%, about 50%, about 60%, about 65%, about 70%, about 75%, about 80%, about 85%, about 90%, or about 95%. In various embodiments, substantial reduction or ablation refers to a greater reduction in binding affinity and/or activity than attenuation or reduction.

In various embodiments, the modified signaling agent comprises one or more mutations that reduce the endogenous activity of the signaling agent to about 75%, or about 70%, or about 60%, or about 50%, or about 40%, or about 30%, or about 25%, or about 20%, or about 10%, or about 5%, or about 3%, or about 1%, e.g., relative to the wild type signaling agent.

In some embodiments, the modified signaling agent comprises one or more mutations that cause the signaling agent to have reduced affinity for its receptor that is lower than the binding affinity of the targeting moiety(ies) for its(their) receptor(s). In some embodiments, this binding affinity differential is between signaling agent/receptor and targeting moiety/receptor on the same cell. In some embodiments, this binding affinity differential allows for the signaling agent, e.g. mutated signaling agent, to have localized, on-target effects and to minimize off-target effects that underlie side effects that are observed with wild type signaling agent. In some embodiments, this binding affinity is at least about 2-fold, or at least about 5-fold, or at least about 10-fold, or at least about 15-fold lower, or at least about 25-fold, or at least about 50-fold lower, or at least about 100-fold, or at least about 150-fold.

Receptor binding activity may be measured using methods known in the art. For example, affinity and/or binding activity may be assessed by Scatchard plot analysis and computer-fitting of binding data (e.g. Scatchard, 1949) or by reflectometric interference spectroscopy under flow through conditions, as described by Brecht et al. (1993), the entire contents of all of which are hereby incorporated by reference.

In various embodiments, the signaling agent is an immune-modulating agent, e.g. one or more of an interleukin, interferon, and tumor necrosis factor.

In some embodiments, the signaling agent is an interleukin or a modified interleukin, including for example IL-1; IL-2; IL-3; IL-4; IL-5; IL-6; IL-7; IL-8; IL-9; IL-10; IL-11; IL-12; IL-13; IL-14; IL-15; IL-16; IL-17; IL-18; IL-19; IL-20; IL-21; IL-22; IL-23; IL-24; IL-25; IL-26; IL-27; IL-28; IL-29; IL-30; IL-31; IL-32; IL-33; IL-35; IL-36 or a fragment, variant, analogue, or family-member thereof. Interleukins are a group of multi-functional cytokines synthesized by lymphocytes, monocytes, and macrophages. Known functions include stimulating proliferation of immune cells (e.g., T helper cells, B cells, eosinophils, and lymphocytes), chemotaxis of neutrophils and T lymphocytes, and/or inhibition of interferons. Interleukin activity can be determined using assays known in the art: Matthews et al., in *Lymphokines and Interferons: A Practical Approach*, Clemens et al., eds, IRL Press, Washington, D.C. 1987, pp. 221-225; and Orencole & Dinarello (1989) Cytokine 1, 14-20.

In some embodiments, the signaling agent is an interferon or a modified version of an interferon such as interferon types I, II, and III. Illustrative interferons, including for example, interferon-α-1, 2, 4, 5, 6, 7, 8, 10, 13, 14, 16, 17, and 21, interferon-β and interferon-γ, interferon κ, interferon ε, interferon τ, and interferon ω.

In some embodiments, the signaling agent is a tumor necrosis factor (TNF) or a modified version of a tumor necrosis factor (TNF) or a protein in the TNF family, including but not limited to, TNF-α, TNF-β, LT-β, CD40L, CD27L, CD30L, FASL, 4-1BBL, OX40L, and TRAIL.

The amino acid sequences of the wild type signaling agents described herein are well known in the art. Accordingly, in various embodiments the modified signaling agent comprises an amino acid sequence that has at least about 60%, or at least about 61%, or at least about 62%, or at least about 63%, or at least about 64%, or at least about 65%, or at least about 66%, or at least about 67%, or at least about 68%, or at least about 69%, or at least about 70%, or at least about 71%, or at least about 72%, or at least about 73%, or at least about 74%, or at least about 75%, or at least about 76%, or at least about 77%, or at least about 78%, or at least about 79%, or at least about 80%, or at least about 81%, or at least about 82%, or at least about 83%, or at least about 84%, or at least about 85%, or at least about 86%, or at least about 87%, or at least about 88%, or at least about 89%, or at least about 90%, or at least about 91%, or at least about 92%, or at least about 93%, or at least about 94%, or at least about 95%, or at least about 96%, or at least about 97%, or at least about 98%, or at least about 99% sequence identity with the known wild type amino acid sequences of the signaling agents described herein (e.g. about 60%, or about 61%, or about 62%, or about 63%, or about 64%, or about 65%, or about 66%, or about 67%, or about 68%, or about 69%, or about 70%, or about 71%, or about 72%, or about 73%, or about 74%, or about 75%, or about 76%, or about 77%, or about 78%, or about 79%, or about 80%, or about 81%, or about 82%, or about 83%, or about 84%, or about 85%, or about 86%, or about 87%, or about 88%, or about 89%, or about 90%, or about 91%, or about 92%, or about 93%, or about 94%, or about 95%, or about 96%, or about 97%, or about 98%, or about 99% sequence identity).

In various embodiments the modified signaling agent comprises an amino acid sequence that has at least about 60%, or at least about 61%, or at least about 62%, or at least about 63%, or at least about 64%, or at least about 65%, or at least about 66%, or at least about 67%, or at least about 68%, or at least about 69%, or at least about 70%, or at least about 71%, or at least about 72%, or at least about 73%, or at least about 74%, or at least about 75%, or at least about 76%, or at least about 77%, or at least about 78%, or at least about 79%, or at least about 80%, or at least about 81%, or at least about 82%, or at least about 83%, or at least about 84%, or at least about 85%, or at least about 86%, or at least about 87%, or at least about 88%, or at least about 89%, or at least about 90%, or at least about 91%, or at least about 92%, or at least about 93%, or at least about 94%, or at least about 95%, or at least about 96%, or at least about 97%, or at least about 98%, or at least about 99% sequence identity with any amino acid sequences of the signaling agents described herein (e.g. about 60%, or about 61%, or about 62%, or about 63%, or about 64%, or about 65%, or about 66%, or about 67%, or about 68%, or about 69%, or about 70%, or about 71%, or about 72%, or about 73%, or about 74%, or about 75%, or about 76%, or about 77%, or about 78%, or about 79%, or about 80%, or about 81%, or about 82%, or about 83%, or about 84%, or about 85%, or about 86%, or about 87%, or about 88%, or about 89%, or about 90%, or about 91%, or about 92%, or about 93%, or about 94%, or about 95%, or about 96%, or about 97%, or about 98%, or about 99% sequence identity).

In various embodiments, the modified signaling agent comprises an amino acid sequence having one or more amino acid mutations. In some embodiments, the one or more amino acid mutations may be independently selected from substitutions, insertions, deletions, and truncations. In some embodiments, the amino acid mutations are amino acid substitutions, and may include conservative and/or non-conservative substitutions, as described elsewhere herein.

In various embodiments, the substitutions may also include non-classical amino acids as described elsewhere herein.

As described herein, the modified signaling agents bear mutations that affect affinity and/or activity at one or more receptors. In various embodiments, there is reduced affinity and/or activity at a therapeutic receptor, e.g. a receptor through which a desired therapeutic effect is mediated (e.g. agonism or antagonism). In various embodiments, the modified signaling agents bear mutations that substantially reduce or ablate affinity and/or activity at a receptor, e.g. a receptor through which a desired therapeutic effect is not mediated (e.g. as the result of promiscuity of binding). The receptors of any signaling agents, as described herein, are known in the art.

Illustrative mutations which provide reduced affinity and/or activity (e.g. agonistic) at a receptor are found in WO 2013/107791 and PCT/EP2017/061544 (e.g. with regard to interferons), WO 2015/007542 (e.g. with regard to interleukins), and WO 2015/007903 (e.g. with regard to TNF), the entire contents of each of which are hereby incorporated by reference. Illustrative mutations which provide reduced affinity and/or activity (e.g. antagonistic) at a therapeutic receptor are found in WO 2015/007520, the entire contents of which are hereby incorporated by reference.

In some embodiments, the modified signaling agent comprises one or more mutations that cause the signaling agent to have reduced affinity and/or activity for a type I cytokine receptor, a type II cytokine receptor, a chemokine receptor, a receptor in the Tumor Necrosis Factor Receptor (TNFR) superfamily, TGF-beta Receptors, a receptor in the immunoglobulin (Ig) superfamily, and/or a receptor in the tyrosine kinase superfamily.

In various embodiments, the receptor for the signaling agent is a Type I cytokine receptor. Type I cytokine receptors are known in the art and include, but are not limited to, receptors for IL2 (beta-subunit), IL3, IL4, IL5, IL6, IL7, IL9, IL11, IL12, GM-CSF, G-CSF, LIF, CNTF, and also the receptors for Thrombopoietin (TPO), Prolactin, and Growth hormone. Illustrative type I cytokine receptors include, but are not limited to, GM-CSF receptor, G-CSF receptor, LIF receptor, CNTF receptor, TPO receptor, and type I IL receptors.

In various embodiments, the receptor for the signaling agent is a Type II cytokine receptor. Type II cytokine receptors are multimeric receptors composed of heterologous subunits and are receptors mainly for interferons. This family of receptors includes, but is not limited to, receptors for interferon-α, interferon-β and interferon-γ, IL10, IL22, and tissue factor. Illustrative type II cytokine receptors include, but are not limited to, IFN-α receptor (e.g. IFNAR1 and IFNAR2), IFN-β receptor, IFN-γ receptor (e.g. IFNGR1 and IFNGR2), and type II IL receptors.

In various embodiments, the receptor for the signaling agent is a G protein-coupled receptor. Chemokine receptors are G protein-coupled receptors with seven transmembrane structure and coupled to G-protein for signal transduction. Chemokine receptors include, but are not limited to, CC chemokine receptors, CXC chemokine receptors, CX3C chemokine receptors, and XC chemokine receptor (XCR1). Illustrative chemokine receptors include, but are not limited to, CCR1, CCR2, CCR3, CCR4, CCR5, CCR6, CCR7, CCR8, CCR9, CCR10, CXCR1, CXCR2, CXCR3, CXCR3B, CXCR4, CXCR5, CSCR6, CXCR7, XCR1, and CX3CR1.

In various embodiments, the receptor for the signaling agent is a TNFR family member. Tumor necrosis factor receptor (TNFR) family members share a cysteine-rich domain (CRD) formed of three disulfide bonds surrounding a core motif of CXXCXXC creating an elongated molecule. Illustrative tumor necrosis factor receptor family members include: CDI 20a (TNFRSFIA), CD 120b (TNFRSFIB), Lymphotoxin beta receptor (LTBR, TNFRSF3), CD 134 (TNFRSF4), CD40 (CD40, TNFRSF5), FAS (FAS, TNFRSF6), TNFRSF6B (TNFRSF6B), CD27 (CD27, TNFRSF7), CD30 (TNFRSF8), CD137 (TNFRSF9), TNFRSFIOA (TNFRSFIOA), TNFRSFIOB, (TNFRSFIOB), TNFRSFIOC (TNFRSFIOC), TNFRSFIOD (TNFRSFIOD), RANK (TNFRSFIIA), Osteoprotegerin (TNFRSFIIB), TNFRSF12A (TNFRSF12A), TNFRSF13B (TNFRSF13B), TNFRSF13C (TNFRSF13C), TNFRSF14 (TNFRSF14), Nerve growth factor receptor (NGFR, TNFRSF16), TNFRSF17 (TNFRSF17), TNFRSF18 (TNFRSF18), TNFRSF19 (TNFRSF19), TNFRSF21 (TNFRSF21), and TNFRSF25 (TNFRSF25). In an embodiment, the TNFR family member is CD120a (TNFRSF1A) or TNF-R1. In another embodiment, the TNFR family member is CD 120b (TNFRSFIB) or TNF-R2.

In various embodiments, the receptor for the signaling agent is a TGF-beta receptor. TGF-beta receptors are single pass serine/threonine kinase receptors. TGF-beta receptors include, but are not limited to, TGFBR1, TGFBR2, and TGFBR3.

In various embodiments, the receptor for the signaling agent is an Ig superfamily receptor. Receptors in the immunoglobulin (Ig) superfamily share structural homology with immunoglobulins. Receptors in the Ig superfamily include, but are not limited to, interleukin-1 receptors, CSF-1R, PDGFR (e.g. PDGFRA and PDGFRB), and SCFR.

In various embodiments, the receptor for the signaling agent is a tyrosine kinase superfamily receptor. Receptors in the tyrosine kinase superfamily are well known in the art. There are about 58 known receptor tyrosine kinases (RTKs), grouped into 20 subfamilies. Receptors in the tyrosine kinase superfamily include, but are not limited to, FGF receptors and their various isoforms such as FGFR1, FGFR2, FGFR3, FGFR4, and FGFR5.

In some embodiments, the modified signaling agent is interferon α. In such embodiments, the modified IFN-α agent has reduced affinity and/or activity for the IFN-α/β receptor (IFNAR), i.e., IFNAR1 and/or IFNAR2 chains. In some embodiments, the modified IFN-α agent has substantially reduced or ablated affinity and/or activity for the IFN-α/β receptor (IFNAR), i.e., IFNAR1 and/or IFNAR2 chains.

Mutant forms of interferon α are known to the person skilled in the art. In an illustrative embodiment, the modified signaling agent is the allelic form IFN-α2a having the amino acid sequence of SEQ ID NO: 46.

In an illustrative embodiment, the modified signaling agent is the allelic form IFN-α2b having the amino acid sequence of SEQ ID NO: 47 (which differs from IFN-α2a at amino acid position 23).

In some embodiments, said IFN-α2 mutant (IFN-α2a or IFN-α2b) is mutated at one or more amino acids at positions 144-154, such as amino acid positions 148, 149 and/or 153. In some embodiments, the IFN-α2 mutant comprises one or more mutations selected from L153A, R149A, and M148A. Such mutants are described, for example, in WO2013/107791 and Piehler et al., (2000) J. Biol. Chem, 275:40425-33, the entire contents of all of which are hereby incorporated by reference.

In some embodiments, the IFN-α2 mutants have reduced affinity and/or activity for IFNAR1. In some embodiments, the IFN-α2 mutant comprises one or more mutations selected from F64A, N65A, T69A, L80A, Y85A, and Y89A, as described in WO2010/030671, the entire contents of which is hereby incorporated by reference.

In some embodiments, the IFN-α2 mutant comprises one or more mutations selected from K133A, R144A, R149A, and L153A as described in WO2008/124086, the entire contents of which is hereby incorporated by reference.

In some embodiments, the IFN-α2 mutant comprises one or more mutations selected from R120E and R120E/K121E, as described in WO2015/007520 and WO2010/030671, the entire contents of which are hereby incorporated by reference. In such embodiments, said IFN-α2 mutant antagonizes wildtype IFN-α2 activity. In such embodiments, said mutant IFN-α2 has reduced affinity and/or activity for IFNAR1 while affinity and/or activity of IFNR2 is retained.

In some embodiments, the human IFN-α2 mutant comprises (1) one or more mutations selected from R120E and R120E/K121E, which, without wishing to be bound by theory, create an antagonistic effect and (2) one or more mutations selected from K133A, R144A, R149A, and L153A, which, without wishing to be bound by theory, allow for an attenuated effect at, for example, IFNAR2. In an embodiment, the human IFN-α2 mutant comprises R120E and L153A.

In some embodiments, the human IFN-α2 mutant comprises one or more mutations selected from, L15A, A19W, R22A, R23A, L26A, F27A, L30A, L30V, K31A, D32A, R33K, R33A, R33Q, H34A, D35A, Q40A, D114R, L117A, R120A, R125A, K134A, R144A, A145G, A145M, M148A, R149A, S152A, L153A, and N156A as disclosed in WO 2013/059885, the entire disclosures of which are hereby incorporated by reference. In some embodiments, the human IFN-α2 mutant comprises the mutations H57Y, E58N, Q61S, and/or L30A as disclosed in WO 2013/059885. In some embodiments, the human IFN-α2 mutant comprises the mutations H57Y, E58N, Q61S, and/or R33A as disclosed in WO 2013/059885. In some embodiments, the human IFN-α2 mutant comprises the mutations H57Y, E58N, Q61S, and/or M148A as disclosed in WO 2013/059885. In some embodiments, the human IFN-α2 mutant comprises the mutations H57Y, E58N, Q61S, and/or L153A as disclosed in WO 2013/059885. In some embodiments, the human IFN-α2 mutant comprises the mutations N65A, L80A, Y85A, and/or Y89A as disclosed in WO 2013/059885. In some embodiments, the human IFN-α2 mutant comprises the mutations N65A, L80A, Y85A, Y89A, and/or D114A as disclosed in WO 2013/059885. In some embodiments, the human IFN-α2 mutant comprises one or more mutations selected from R144$X_1$, A145$X_2$, and R33A, wherein $X_1$ is selected from A, S, T, Y, L, and I, and wherein $X_2$ is selected from G, H, Y, K, and D.

In some embodiments, the human IFN-α2 mutant comprises one or more mutations that was for aglycosylation, e.g. in which the amino acid residue at position 106 (T) is substituted with a member of the group of of A, C, D, E, F, G, H, I, K, L, M, N, P, Q, R, S, V, W and Y. In some embodiments, the human IFN-α2 mutant comprises a T106A mutation. In various embodiments, the mutation at position 106 is in addition to the other IFN-α2 mutations described herein.

In some embodiments, the modified signaling agent is interferon β. In such embodiments, the modified interferon β agent has reduced affinity and/or activity for the IFN-α/β receptor (IFNAR), i.e., IFNAR1 and/or IFNAR2 chains. In some embodiments, the modified interferon p agent has substantially reduced or ablated affinity and/or activity for the IFN-α/β receptor (IFNAR), i.e., IFNAR1 and/or IFNAR2 chains.

In an embodiment, the modified signaling agent is interferon β. In such embodiments, the modified interferon β agent has reduced affinity and/or activity for the IFN-α/β receptor (IFNAR), i.e., IFNAR1 and/or IFNAR2 chains. In some embodiments, the modified interferon β agent has substantially reduced or ablated affinity and/or activity for the IFN-α/β receptor (IFNAR), i.e., IFNAR1 and/or IFNAR2 chains.

In an illustrative embodiment, the modified signaling agent is IFN-β. In various embodiments, the IFN-β encompasses functional derivatives, analogs, precursors, isoforms, splice variants, or fragments of IFN-β. In various embodiments, the IFN-β encompasses IFN-β derived from any species. In an embodiment, the chimeric protein or chimeric protein complex comprises a modified version of mouse IFN-β. In another embodiment, the chimeric protein or chimeric protein complex comprises a modified version of human IFN-β. Human IFN-β is a polypeptide with a molecular weight of about 22 kDa comprising 166 amino acid residues. The amino acid sequence of human IFN-β is SEQ ID NO: 48.

In some embodiments, the human IFN-β is IFN-β-1a which is a glycosylated form of human IFN-β. In some embodiments, the human IFN-β is IFN-β-1b which is a non-glycosylated form of human IFN-β that has a Met-1 deletion and a Cys-17 to Ser mutation.

In various embodiments, the modified IFN-β has one or more mutations that reduce its binding to or its affinity for the IFNAR1 subunit of IFNAR. In one embodiment, the modified IFN-β has reduced affinity and/or activity at IFNAR1. In various embodiments, the modified IFN-β is human IFN-β and has one or more mutations at positions F67, R71, L88, Y92, 195, N96, K123, and R124. In some embodiments, the one or more mutations are substitutions selected from F67G, F67S, R71A, L88G, L88S, Y92G, Y92S, 195A, N96G, K123G, and R124G. In an embodiment, the modified IFN-β comprises the F67G mutation. In an embodiment, the modified IFN-β comprises the K123G mutation. In an embodiment, the modified IFN-β comprises the F67G and R71A mutations. In an embodiment, the modified IFN-β comprises the L88G and Y92G mutations. In an embodiment, the modified IFN-β comprises the Y92G, 195A, and N96G mutations. In an embodiment, the modified IFN-β comprises the K123G and R124G mutations. In an embodiment, the modified IFN-β comprises the F67G, L88G, and Y92G mutations. In an embodiment, the modified IFN-β comprises the F67S, L88S, and Y92S mutations.

In some embodiments, the modified IFN-β has one or more mutations that reduce its binding to or its affinity for the IFNAR2 subunit of IFNAR. In one embodiment, the modified IFN-β has reduced affinity and/or activity at IFNAR2. In various embodiments, the modified IFN-β is human IFN-β and has one or more mutations at positions W22, R27, L32, R35, V148, L151, R152, and Y155. In some embodiments, the one or more mutations are substitutions selected from W22G, R27G, L32A, L32G, R35A, R35G, V148G, L151G, R152A, R152G, and Y155G. In an embodiment, the modified IFN-β comprises the W22G mutation. In an embodiment, the modified IFN-β comprises the L32A mutation. In an embodiment, the modified IFN-β comprises the L32G mutation. In an embodiment, the modified IFN-β comprises the R35A mutation. In an embodiment, the modified IFN-β comprises the R35G mutation. In an embodiment, the modified IFN-β comprises the V148G mutation. In an embodiment, the modified IFN-β comprises the R152A mutation. In an embodiment, the modified IFN-β comprises the R152G mutation. In an embodiment, the modified IFN-β comprises the Y155G mutation. In an embodiment, the modified IFN-β comprises the W22G and R27G mutations. In an embodiment, the modified IFN-β comprises the L32A and R35A mutation. In an embodiment, the modified IFN-β comprises the L151G and R152A mutations. In an embodiment, the modified IFN-β comprises the V148G and R152A mutations.

In some embodiments, the modified IFN-β has one or more of the following mutations: R35A. R35T, E42K, M62I, G78S, A141Y, A142T, E149K, and R152H. In some embodiments, the modified IFN-β has one or more of the following mutations: R35A, R35T, E42K, M62I, G78S, A141Y, A142T, E149K, and R152H in combination with C17S or C17A.

In some embodiments, the modified IFN-β has one or more of the following mutations: R35A. R35T, E42K, M62I G78S, A141Y, A142T, E149K, and R152H in combination with any of the other IFN-β mutations described herein.

The crystal structure of human IFN-β is known and is described in Karpusas et al., (1998) PNAS, 94(22): 11813-11818. Specifically, the structure of human IFN-β has been shown to include five α-helices (i.e., A, B, C, D, and E) and four loop regions that connect these helices (i.e., AB, BC, CD, and DE loops). In various embodiments, the modified IFN-β has one or more mutations in the A, B, C, D, E helices and/or the AB, BC, CD, and DE loops which reduce its binding affinity or activity at a therapeutic receptor such as IFNAR. Illustrative mutations are described in WO2000/023114 and US20150011732, the entire contents of which are hereby incorporated by reference. In an illustrative embodiment, the modified IFN-β is human IFN-β comprising alanine substitutions at amino acid positions 15, 16, 18, 19, 22, and/or 23. In an illustrative embodiment, the modified IFN-β is human IFN-β comprising alanine substitutions at amino acid positions 28-30, 32, and 33. In an illustrative embodiment, the modified IFN-β is human IFN-β comprising alanine substitutions at amino acid positions 36, 37, 39, and 42. In an illustrative embodiment, the modified IFN-β is human IFN-β comprising alanine substitutions at amino acid positions 64 and 67 and a serine substitution at position 68. In an illustrative embodiment, the modified IFN-β is human IFN-β comprising alanine substitutions at amino acid positions 71-73. In an illustrative embodiment, the modified IFN-β is human IFN-β comprising alanine substitutions at amino acid positions 92, 96, 99, and 100. In an illustrative embodiment, the modified IFN-β is human IFN-β comprising alanine substitutions at amino acid positions 128, 130, 131, and 134. In an illustrative embodiment, the modified IFN-β is human IFN-β comprising alanine substitutions at amino acid positions 149, 153, 156, and 159. In some embodiments, the mutant IFNβ comprises SEQ ID NO:48 and a mutation at W22, the mutation being an aliphatic hydrophobic residue selected from glycine (G), alanine (A), leucine (L), isoleucine (I), methionine (M), and valine (V).

In some embodiments, the mutant IFNβ comprises SEQ ID NO: 48 and a mutation at R27, the mutation being an aliphatic hydrophobic residue selected from glycine (G), alanine (A), leucine (L), isoleucine (I), methionine (M), and valine (V).

In some embodiments, the mutant IFNβ comprises SEQ ID NO:48 and a mutation at W22, the mutation being an aliphatic hydrophobic residue selected from glycine (G), alanine (A), leucine (L), isoleucine (I), methionine (M), and valine (V) and a mutation at R27, the mutation being an aliphatic hydrophobic residue selected from glycine (G), alanine (A), leucine (L), isoleucine (I), methionine (M), and valine (V).

In some embodiments, the mutant IFNβ comprises SEQ ID NO: 48 and a mutation at L32, the mutation being an aliphatic hydrophobic residue selected from glycine (G), alanine (A), isoleucine (I), methionine (M), and valine (V).

In some embodiments, the mutant IFNβ comprises SEQ ID NO: 48 and a mutation at R35, the mutation being an aliphatic hydrophobic residue selected from glycine (G), alanine (A), leucine (L), isoleucine (I), methionine (M), and valine (V).

In some embodiments, the mutant IFNβ comprises SEQ ID NO: 48 and a mutation at L32, the mutation being an aliphatic hydrophobic residue selected from glycine (G), alanine (A), isoleucine (I), methionine (M), and valine (V) and a mutation at R35, the mutation being an aliphatic hydrophobic residue selected from glycine (G), alanine (A), leucine (L), isoleucine (I), methionine (M), and valine (V).

In some embodiments, the mutant IFNβ comprises SEQ ID NO: 48 and a mutation at F67, the mutation being an aliphatic hydrophobic residue selected from glycine (G), alanine (A), leucine (L), isoleucine (I), methionine (M), and valine (V).

In some embodiments, the mutant IFNβ comprises SEQ ID NO: 48 and a mutation at R71, the mutation being an aliphatic hydrophobic residue selected from glycine (G), alanine (A), leucine (L), isoleucine (I), methionine (M), and valine (V).

In some embodiments, the mutant IFNβ comprises SEQ ID NO: 48 and a mutation at F67, the mutation being an aliphatic hydrophobic residue selected from glycine (G), alanine (A), leucine (L), isoleucine (I), methionine (M), and valine (V) and a mutation at R71, the mutation being an aliphatic hydrophobic residue selected from glycine (G), alanine (A), leucine (L), isoleucine (I), methionine (M), and valine (V).

In some embodiments, the mutant IFNβ comprises SEQ ID NO: 48 and a mutation at L88, the mutation being an aliphatic hydrophobic residue selected from glycine (G), alanine (A), isoleucine (I), methionine (M), and valine (V).

In some embodiments, the mutant IFNβ comprises SEQ ID NO: 48 and a mutation at Y92, the mutation being an aliphatic hydrophobic residue selected from glycine (G), alanine (A), leucine (L), isoleucine (I), methionine (M), and valine (V).

In some embodiments, the mutant IFNβ comprises SEQ ID NO: 48 and a mutation at F67, the mutation being an aliphatic hydrophobic residue selected from glycine (G), alanine (A), leucine (L), isoleucine (I), methionine (M), and valine (V) and a mutation at L88, the mutation being an aliphatic hydrophobic residue selected from glycine (G), alanine (A), isoleucine (I), methionine (M), and valine (V) and a mutation at Y92, the mutation being an aliphatic hydrophobic residue selected from glycine (G), alanine (A), leucine (L), isoleucine (I), methionine (M), and valine (V).

In some embodiments, the mutant IFNβ comprises SEQ ID NO: 48 and a mutation at L88, the mutation being an aliphatic hydrophobic residue selected from glycine (G), alanine (A), isoleucine (I), methionine (M), and valine (V) and a mutation at Y92, the mutation being an aliphatic hydrophobic residue selected from glycine (G), alanine (A), leucine (L), isoleucine (I), methionine (M), and valine (V).

In some embodiments, the mutant IFNβ comprises SEQ ID NO: 48 and a mutation at 195, the mutation being an aliphatic hydrophobic residue selected from glycine (G), alanine (A), leucine (L), methionine (M), and valine (V) and a mutation at Y92, the mutation being an aliphatic hydrophobic residue selected from glycine (G), alanine (A), leucine (L), isoleucine (I), methionine (M), and valine (V).

In some embodiments, the mutant IFNβ comprises SEQ ID NO: 48 and a mutation at N96, the mutation being an aliphatic hydrophobic residue selected from glycine (G), alanine (A), leucine (L), isoleucine (I), methionine (M), and valine (V) and a mutation at Y92, the mutation being an aliphatic hydrophobic residue selected from glycine (G), alanine (A), leucine (L), isoleucine (I), methionine (M), and valine (V).

In some embodiments, the mutant IFNβ comprises SEQ ID NO: 48 and a mutation at Y92, the mutation being an aliphatic hydrophobic residue selected from glycine (G), alanine (A), leucine (L), isoleucine (I), methionine (M), and valine (V) and a mutation at 195, the mutation being an aliphatic hydrophobic residue selected from glycine (G), alanine (A), leucine (L), methionine (M), and valine (V) and a mutation at N96, the mutation being an aliphatic hydrophobic residue selected from glycine (G), alanine (A), leucine (L), isoleucine (I), methionine (M), and valine (V).

In some embodiments, the mutant IFNβ comprises SEQ ID NO: 48 and a mutation at K123, the mutation being an aliphatic hydrophobic residue selected from glycine (G), alanine (A), leucine (L), isoleucine (I), methionine (M), and valine (V).

In some embodiments, the mutant IFNβ comprises SEQ ID NO: 48 and a mutation at R124, the mutation being an aliphatic hydrophobic residue selected from glycine (G), alanine (A), leucine (L), isoleucine (I), methionine (M), and valine (V).

In some embodiments, the mutant IFNβ comprises SEQ ID NO: 48 and a mutation at K123, the mutation being an aliphatic hydrophobic residue selected from glycine (G), alanine (A), leucine (L), isoleucine (I), methionine (M), and valine (V) and a mutation at R124, the mutation being an aliphatic hydrophobic residue selected from glycine (G), alanine (A), leucine (L), isoleucine (I), methionine (M), and valine (V).

In some embodiments, the mutant IFNβ comprises SEQ ID NO: 48 and a mutation at L151, the mutation being an aliphatic hydrophobic residue selected from glycine (G), alanine (A), isoleucine (I), methionine (M), and valine (V).

In some embodiments, the mutant IFNβ comprises SEQ ID NO: 48 and a mutation at R152, the mutation being an aliphatic hydrophobic residue selected from glycine (G), alanine (A), leucine (L), isoleucine (I), methionine (M), and valine (V).

In some embodiments, the mutant IFNβ comprises SEQ ID NO: 48 and a mutation at L151, the mutation being an aliphatic hydrophobic residue selected from glycine (G), alanine (A), isoleucine (I), methionine (M), and valine (V) and a mutation at R152, the mutation being an aliphatic hydrophobic residue selected from glycine (G), alanine (A), leucine (L), isoleucine (I), methionine (M), and valine (V).

In some embodiments, the mutant IFNβ comprises SEQ ID NO:48 and a mutation at V148, the mutation being an aliphatic hydrophobic residue selected from glycine (G), alanine (A), leucine (L), isoleucine (I), and methionine (M).

In some embodiments, the mutant IFNβ comprises SEQ ID NO: 48 and a mutation at V148, the mutation being an aliphatic hydrophobic residue selected from glycine (G), alanine (A), leucine (L), isoleucine (I), methionine (M), and valine (V) and a mutation at R152, the mutation being an aliphatic hydrophobic residue selected from glycine (G), alanine (A), leucine (L), isoleucine (I), methionine (M), and valine (V).

In some embodiments, the mutant IFNβ comprises SEQ ID NO: 48 and a mutation at Y155, the mutation being an aliphatic hydrophobic residue selected from glycine (G), alanine (A), leucine (L), isoleucine (I), methionine (M), and valine (V).

In some embodiments, the present invention relates to a chimeric protein or chimeric protein complex comprising: (a) a modified IFN-β, having the amino acid sequence of SEQ ID NO: 48 and a mutation at position W22, wherein the mutation is an aliphatic hydrophobic residue; and (b) one or more targeting moieties, said targeting moieties comprising recognition domains which specifically bind to antigens or receptors of interest (e.g., Clec4C), the modified IFN-β and the one or more targeting moieties are optionally connected with one or more linkers. In various embodiments the mutation at position W22 is aliphatic hydrophobic residue is selected from G, A, L, I, M, and V. In various embodiments the mutation at position W22 is G.

Additional illustrative IFNβ mutants are provided in PCT/EP2017/061544, the entire disclosure of which is incorporated by reference herein.

In some embodiments, the modified signaling agent is interferon γ. In such embodiments, the modified interferon γ agent has reduced affinity and/or activity for the interferon-gamma receptor (IFNGR), i.e., IFNGR1 and IFNGR2 chains. In some embodiments, the modified interferon γ agent has substantially reduced or ablated affinity and/or activity for the interferon-gamma receptor (IFNGR), i.e., IFNGR1 and/or IFNGR2 chains.

IFN-γ is the only member of the type II class of interferons. IFN-γ is produced predominantly by natural killer (NK) and natural killer T (NKT) cells as part of the innate immune response. IFN-γ is also produced by CD4 Th1 and CD8 cytotoxic T lymphocyte (CTL) effector T cells, macrophages, dendritic cells, and B cells. Activated IFN-γ forms a dimer which acts through a heterodimeric receptor (i.e., IFN-γ receptor or IFN-γR) composed of IFN-γ receptor 1 and IFN-γ receptor 2 subunits. IFN-γ receptor 1 is the major ligand-binding subunit, while IFN-γ receptor 2 is necessary for signal transduction and also increases the affinity of IFN-γ receptor 1 for its ligand. Binding of the IFN-γ dimer to the receptor activates the JAK-STAT signaling pathway to elicit various biological effects.

In various embodiments, the modified signaling agent comprises a modified version of IFN-γ as a signaling agent. In various embodiments, the IFN-γ encompasses functional derivatives, analogs, precursors, isoforms, splice variants, or fragments of IFN-γ. In various embodiments, the IFN-γ encompasses IFN-γ derived from any species. In an embodiment, the modified signaling agent comprises a modified version of mouse IFN-γ. In another embodiment, the modified signaling agent comprises a modified version of human IFN-γ.

Human IFN-γ is a polypeptide comprising 166 amino acid residues. In an embodiment, the human IFN-γ has the amino acid sequence of SEQ ID NO: 330, in which the signal peptide comprises the first 23 amino acids.

```
                        (SEQ ID NO: 330; N-terminal
                              signal peptide underlined)
MKYTSYILAFQLCIVLGSLGCYCQDPYVKEAENLKKYFNAGHSDVADNGTL

FLGILKNWKEESDRKIMQSQIVSFYFKLFKNFKDDQSIQKSVETIKEDMNV

KFFNSNKKKRDDFEKLTNYSVTDLNVQRKAIHELIQVMAELSPAAKTGKRK

RSQMLFRGRRASQ.
```

As used herein, human IFN-γ may also refer to mature human IFN-γ without the N-terminal signal peptide. In this embodiment, the mature human IFN-γ comprises 143 amino acids and has the amino acid sequence of:

```
                                       (SEQ ID NO: 331)
QDPYVKEAENLKKYFNAGHSDVADNGTLFLGILKNWKEESDRKIMQSQIVS

FYFKLFKNFKDDQSIQKSVETIKEDMNVKFFNSNKKKRDDFEKLTNYSVTD

LNVQRKAIHELIQVMAELSPAAKTGKRKRSQMLFRGRRASQ.
```

In some embodiments, the human IFN-γ is a glycosylated form of human IFN-γ. In some embodiments, the human IFN-γ is a non-glycosylated form of human IFN-γ.

The sequences of IFN-γ are known in the art. In various embodiments the modified IFN-γ comprises an amino acid sequence that has at least about 60%, or at least about 61%, or at least about 62%, or at least about 63%, or at least about 64%, or at least about 65%, or at least about 66%, or at least about 67%, or at least about 68%, or at least about 69%, or at least about 70%, or at least about 71%, or at least about 72%, or at least about 73%, or at least about 74%, or at least about 75%, or at least about 76%, or at least about 77%, or at least about 78%, or at least about 79%, or at least about 80%, or at least about 81%, or at least about 82%, or at least about 83%, or at least about 84%, or at least about 85%, or at least about 86%, or at least about 87%, or at least about 88%, or at least about 89%, or at least about 90%, or at least about 91%, or at least about 92%, or at least about 93%, or at least about 94%, or at least about 95%, or at least about 96%, or at least about 97%, or at least about 98%, or at least about 99% sequence identity with the known wild type amino acid sequences of IFN-γ (e.g., about 60%, or about 61%, or about 62%, or about 63%, or about 64%, or about 65%, or about 66%, or about 67%, or about 68%, or about 69%, or about 70%, or about 71%, or about 72%, or about 73%, or about 74%, or about 75%, or about 76%, or about 77%, or about 78%, or about 79%, or about 80%, or about 81%, or about 82%, or about 83%, or about 84%, or about 85%, or about 86%, or about 87%, or about 88%, or about 89%, or about 90%, or about 91%, or about 92%, or about 93%, or about 94%, or about 95%, or about 96%, or about 97%, or about 98%, or about 99% sequence identity).

In some embodiments the modified IFN-γ comprises an amino acid sequence that has at least about 60%, or at least about 61%, or at least about 62%, or at least about 63%, or at least about 64%, or at least about 65%, or at least about 66%, or at least about 67%, or at least about 68%, or at least about 69%, or at least about 70%, or at least about 71%, or at least about 72%, or at least about 73%, or at least about 74%, or at least about 75%, or at least about 76%, or at least about 77%, or at least about 78%, or at least about 79%, or at least about 80%, or at least about 81%, or at least about 82%, or at least about 83%, or at least about 84%, or at least about 85%, or at least about 86%, or at least about 87%, or at least about 88%, or at least about 89%, or at least about 90%, or at least about 91%, or at least about 92%, or at least about 93%, or at least about 94%, or at least about 95%, or at least about 96%, or at least about 97%, or at least about 98%, or at least about 99% sequence identity with human IFN-γ having an amino acid sequence of SEQ ID NO: 330 (e.g., about 60%, or about 61%, or about 62%, or about 63%, or about 64%, or about 65%, or about 66%, or about 67%, or about 68%, or about 69%, or about 70%, or about 71%, or about 72%, or about 73%, or about 74%, or about 75%, or about 76%, or about 77%, or about 78%, or about 79%, or about 80%, or about 81%, or about 82%, or about 83%, or about 84%, or about 85%, or about 86%, or about 87%, or about 88%, or about 89%, or about 90%, or about 91%, or about 92%, or about 93%, or about 94%, or about 95%, or about 96%, or about 97%, or about 98%, or about 99% sequence identity).

In some embodiments the modified IFN-γ comprises an amino acid sequence that has at least about 60%, or at least about 61%, or at least about 62%, or at least about 63%, or at least about 64%, or at least about 65%, or at least about 66%, or at least about 67%, or at least about 68%, or at least about 69%, or at least about 70%, or at least about 71%, or at least about 72%, or at least about 73%, or at least about 74%, or at least about 75%, or at least about 76%, or at least about 77%, or at least about 78%, or at least about 79%, or at least about 80%, or at least about 81%, or at least about 82%, or at least about 83%, or at least about 84%, or at least about 85%, or at least about 86%, or at least about 87%, or at least about 88%, or at least about 89%, or at least about 90%, or at least about 91%, or at least about 92%, or at least about 93%, or at least about 94%, or at least about 95%, or at least about 96%, or at least about 97%, or at least about 98%, or at least about 99% sequence identity with human IFN-γ having an amino acid sequence of SEQ ID NO: 331 (e.g., about 60%, or about 61%, or about 62%, or about 63%, or about 64%, or about 65%, or about 66%, or about 67%, or about 68%, or about 69%, or about 70%, or about 71%, or about 72%, or about 73%, or about 74%, or about 75%, or about 76%, or about 77%, or about 78%, or about 79%, or about 80%, or about 81%, or about 82%, or about 83%, or about 84%, or about 85%, or about 86%, or about 87%, or about 88%, or about 89%, or about 90%, or about 91%, or about 92%, or about 93%, or about 94%, or about 95%, or about 96%, or about 97%, or about 98%, or about 99% sequence identity).

In various embodiments, the modified IFN-γ comprises an amino acid sequence having one or more amino acid mutations. In some embodiments, the one or more amino acid mutations may be independently selected from substitutions, insertions, deletions, and truncations.

In some embodiments, the amino acid mutations are amino acid substitutions, and may include conservative and/or non-conservative substitutions.

"Conservative substitutions" may be made, for instance, on the basis of similarity in polarity, charge, size, solubility, hydrophobicity, hydrophilicity, and/or the amphipathic nature of the amino acid residues involved. The 20 naturally occurring amino acids can be grouped into the following six standard amino acid groups: (1) hydrophobic: Met, Ala, Val, Leu, Ile; (2) neutral hydrophilic: Cys, Ser, Thr; Asn, Gln; (3) acidic: Asp, Glu; (4) basic: His, Lys, Arg; (5) residues that influence chain orientation: Gly, Pro; and (6) aromatic: Trp, Tyr, Phe.

As used herein, "conservative substitutions" are defined as exchanges of an amino acid by another amino acid listed within the same group of the six standard amino acid groups shown above. For example, the exchange of Asp by Glu retains one negative charge in the so modified polypeptide. In addition, glycine and proline may be substituted for one another based on their ability to disrupt α-helices.

As used herein, "non-conservative substitutions" are defined as exchanges of an amino acid by another amino acid listed in a different group of the six standard amino acid groups (1) to (6) shown above.

In various embodiments, the substitutions may also include non-classical amino acids (e.g., selenocysteine, pyrrolysine, N-formylmethionine β-alanine, GABA and δ-Aminolevulinic acid, 4-aminobenzoic acid (PABA), D-isomers of the common amino acids, 2,4-diaminobutyric acid, α-amino isobutyric acid, 4-aminobutyric acid, Abu, 2-amino butyric acid, γ-Abu, ε-Ahx, 6-amino hexanoic acid, Aib, 2-amino isobutyric acid, 3-amino propionic acid, ornithine, norleucine, norvaline, hydroxyproline, sarcosme, citrulline, homocitrulline, cysteic acid, t-butylglycine, t-butylalanine, phenylglycine, cyclohexylalanine, β-alanine, fluoro-amino acids, designer amino acids such as β methyl amino acids, C α-methyl amino acids, N α-methyl amino acids, and amino acid analogs in general).

In various embodiments, the IFN-γ is modified to have one or more mutations. In some embodiments, the mutations allow for the modified IFN-γ to have one or more of attenuated activity such as one or more of reduced binding affinity, reduced endogenous activity, and reduced specific bioactivity relative to unmutated, e.g., the wild type form of IFN-γ. For instance, the one or more of attenuated activity such as reduced binding affinity, reduced endogenous activity, and reduced specific bioactivity relative to unmutated, e.g., the wild type form of IFN-γ may be at a therapeutic receptor such as the IFN-γ receptor. Consequentially, in various embodiments, the mutations allow for the modified soluble agent to have reduced systemic toxicity, reduced side effects, and reduced off-target effects relative to unmutated, e.g., the wild type form of IFN-γ.

In various embodiments, the IFN-γ is modified to have a mutation that reduces its binding affinity and/or activity at a therapeutic receptor such as the IFN-γ receptor comprising the IFN-γ receptor 1 and IFN-γ receptor 2 subunits. In some embodiments, the activity provided by the wild type IFN-γ is agonism at the therapeutic receptor (e.g., activation of a cellular effect at a site of therapy). For example, the wild type IFN-γ may activate the therapeutic receptor. In such embodiments, the mutation results in the modified IFN-γ to have reduced activating activity at the therapeutic receptor.

In some embodiments, the reduced affinity and/or activity at the therapeutic receptor (e.g., IFN-γ receptor) is restorable by attachment with a targeting moiety. In other embodiments, the reduced affinity and/or activity at the therapeutic receptor is not substantially restorable by attachment with the targeting moiety. In various embodiments, the therapeutic chimeric proteins or chimeric protein complexes of the present invention reduce off-target effects because the IFN-γ has mutations that weaken binding affinity and/or activity at a therapeutic receptor.

In various embodiments, this reduces side effects observed with, for example, the wild type IFN-γ. In various embodiments, the modified IFN-γ is substantially inactive en route to the site of therapeutic activity and has its effect substantially on specifically targeted cell types which greatly reduces undesired side effects.

In various embodiments, the modified IFN-γ has one or more mutations that cause the IFN-γ to have attenuated or reduced affinity and/or activity, e.g., binding (e.g., $K_D$) and/or activation (measurable as, for example, KA and/or EC50) for one or more therapeutic receptors (e.g., IFN-γ receptor). In various embodiments, the reduced affinity and/or activity at the therapeutic receptor allows for attenuation of activity and/or signaling from the therapeutic receptor.

In various embodiments, the modified IFN-γ has one or more mutations that reduce its binding to or its affinity for and/or biological activity for the IFN-γ receptor 1 subunit. In one embodiment, the modified IFN-γ has reduced affinity and/or activity at the IFN-γ receptor 1 subunit. In various embodiments, the modified IFN-γ is human IFN-γ that has one or more mutations at amino acid residues involved with binding to the IFN-γ receptor 1 subunit. In some embodiments, the modified IFN-γ is human IFN-γ that has one or more mutations at amino acids located at the interface with the IFN-γ receptor 1 subunit. In various embodiments, the one or more mutations are at amino acids selected from, but not limited to Q1, V5, E9, K12, H19, S20, V22, A23, D24, N25, G26, T27, L30, K108, H111, E112, I114, Q115, A118, E119, and K125 (each with respect SEQ ID NO: 331, which is a wild type human IFN-γ and which lacks its N-terminal signal sequence). In some embodiments, the one or more mutations are substitutions selected from V5E, S20E, V22A, A23G, A23F, D24G, G26Q, H111A, H111D, I114A, Q115A, and A118G (each with respect SEQ ID NO: 331). In embodiments, the one or more mutations are substitutions selected from V22A, A23G, D24G, H111A, H111D, I114A, Q115A, and A118G.

In an embodiment, the modified IFN-γ comprises the mutations A23G and D24G. In another embodiment, the modified IFN-γ comprises the mutations I114A and A118G. In a further embodiment, the modified IFN-γ comprises the mutations V5E, S20E, A23F, and G26Q.

In various embodiments, the modified IFN-γ has one or more of the following mutations: deletion of residue A23, deletion of residue D24, an S20I substitution, an A23V substitution, a D21K substitution and a D24A substitution.

In some embodiments, the modified IFN-γ has one or more mutations that reduce its binding to or its affinity and/or biological activity for the IFN-γ receptor 2 subunit.

In some embodiments, the modified IFN-γ has one or more mutations that reduce its binding to or its affinity and/or biological activity for both IFN-γ receptor 1 and IFN-γ receptor 2 subunits.

In some embodiments, the modified IFN-γ has one or more mutations that reduce its binding to or its affinity and/or biological activity for IFN-γ receptor 1 and one or more mutations that substantially reduce or ablate binding to or its affinity and/or biological activity for IFN-γ receptor 2. In some embodiments, chimeric proteins or chimeric protein complexes with such modified IFN-γ can provide target-selective IFN-γ receptor 1 activity (e.g., IFN-γ receptor 1 activity is restorable via targeting through the targeting moiety).

In some embodiments, the modified IFN-γ has one or more mutations that reduce its binding to or its affinity and/or biological activity for IFN-γ receptor 1 and one or more mutations that reduce its binding to or its affinity and/or biological activity for IFN-γ receptor 1. In some embodiments, chimeric proteins or chimeric protein complexes with such modified IFN-γ can provide target-selective IFN-γ receptor 1 and/or IFN-γ receptor 1 activity (e.g., IFN-γ receptor 1 and IFN-γ receptor 2 activities are restorable via targeting through the targeting moiety).

In various embodiments, the modified IFN-γ is truncated at the C-terminus. In some embodiments, the modified IFN-γ is mature IFN-γ comprising the amino acid sequence of SEQ ID NO: 331 with deletions of the C-terminal terminus. In such embodiments, the mature IFN-γ may comprise a C-terminal truncation of at least about 1, about 2, about 3, about 4, about 5, about 6, about 7, about 8, about 9, about 10, about 11, about 12, about 13, about 14, about 15, about 16, about 17, about 18, about 19, about 20, about 21, about 22, about 23, about 24, or about 25 amino acid residues. In an embodiment, the modified IFN-γ is mature IFN-γ comprising the amino acid sequence of SEQ ID NO: 331 with C-terminal deletions of 5 amino acids. In an embodiment, the modified IFN-γ is mature IFN-γ comprising the amino acid sequence of SEQ ID NO: 331 with C-terminal deletions of 7 amino acids. In an embodiment, the modified IFN-γ is mature IFN-γ comprising the amino acid sequence of SEQ ID NO: 331 with C-terminal deletions of 14 amino acids. In an embodiment, the modified IFN-γ is mature IFN-γ comprising the amino acid sequence of SEQ ID NO: 331 with C-terminal deletions of 15 amino acids. In an embodiment, the modified IFN-γ is mature IFN-γ comprising the amino acid sequence of SEQ ID NO: 331 with C-terminal deletions of 16 amino acids. Additional modified IFN-γ with C-terminal truncations that may be utilized in the present invention is described in Haelewyn et al., Biochem. J. (1997), 324:591-595 and Lundell et al., Protein Eng. (1991) 4:335-341, the entire contents are hereby incorporated by reference In various embodiments, the modified IFN-γ is a single chain IFN-γ as described, for example, in Randal et al. (2001) Structure 9:155-163 and Randal et al. (1998) Protein Sci. 7:1057-1060, the entire contents are hereby incorporated by reference. In some embodiments, the single chain IFN-γ comprises a first IFN-γ chain linked at its C-terminus to the N-terminus of a second IFN-γ chain. In various embodiments, the first and second IFN-γ chains are linked by a linker, as described elsewhere herein.

In some embodiments, the first IFN-γ chain comprises a C-terminal truncation of at least about 1, about 2, about 3, about 4, about 5, about 6, about 7, about 8, about 9, about 10, about 11, about 12, about 13, about 14, about 15, about 16, about 17, about 18, about 19, about 20, about 21, about 22, about 23, about 24, or about 25 amino acid residues. In an embodiment, the first IFN-γ chain comprises a C-terminal truncation of about 24 amino acid residues. In some embodiments, the second IFN-γ chain comprises an N-terminal truncation of at least about 1, about 2, about 3, about 4, or about 5 amino acid residues. In an embodiment, the second IFN-γ chain comprises an N-terminal truncation of about 3 amino acid residues. In some embodiments, the second IFN-γ chain comprises a C-terminal truncation of at least about 1, about 2, about 3, about 4, about 5, about 6, about 7, about 8, about 9, about 10, about 11, about 12, about 13, about 14, about 15, about 16, about 17, about 18, about 19, about 20, about 21, about 22, about 23, about 24, or about 25 amino acid residues. In various embodiments, the first and/or second IFN-γ chains comprise one or more amino acid mutations at Q1, V5, E9, K12, H19, S20, V22, A23, D24, N25, G26, T27, L30, K108, H111, E112, I114, Q115, A118, E119, and K125, as described elsewhere herein. In various embodiments, the first and/or second IFN-γ chains comprise one or more substitutions selected from V5E, S20E, V22A, A23G, A23F, D24G, G26Q, H111A, H111D, I114A, Q115A, and A118G. In various embodiments, the first and/or second IFN-γ chains comprise one or more substitutions selected from V22A, A23G, D24G, H111A, H111D, I114A, Q115A, and A118G. In various embodiments, the first and/or second IFN-γ chains comprise the A23G and the D24G substitution. In various embodiments, the first and/or second IFN-γ chains comprise the I114A and the A118G substitution. In another embodiment, the mutations are V5E, S20E, A23F, and G26Q.

In various embodiments, a first and/or second IFN-γ chain comprises one or more substitutions as disclosed herein and the first and/or second IFN-γ chain comprises a C-terminal truncation as disclosed herein.

In various embodiments, a first and/or second IFN-γ chain comprises one or more substitutions as disclosed herein and a C-terminal truncation as disclosed herein.

The crystal structure of human IFN-γ is known and is described in, for example, Ealick et al., (1991) Science, 252: 698-702. Specifically, the structure of human IFN-γ has been shown to include a core of six α-helices and an extended unfolded sequence in the C-terminal region. In various embodiments, the modified IFN-γ has one or more mutations in the one or more helices which reduce its binding affinity and/or biological activity at a therapeutic receptor (e.g., IFN-γ receptor).

In various embodiments, the modified IFN-γ has about 1%, or about 3%, about 5%, about 10%, about 15%, about 20%, about 25%, about 30%, about 35%, about 40%, about 45%, about 50%, about 60%, about 65%, about 70%, about 75%, about 80%, about 85%, about 90%, about 95%, or about 10%-20%, about 20%-40%, about 50%, about 40%-60%, about 60%-80%, about 80%-100% of the affinity and/or biological activity for the therapeutic receptor (e.g., IFN-γ receptor or any one of its IFN-γ receptor 1 and IFN-γ receptor 2 subunits) relative to the wild type IFN-γ. In some embodiments, the binding affinity and/or biological activity is at least about 2-fold lower, about 3-fold lower, about 4-fold lower, about 5-fold lower, about 6-fold lower, about 7-fold lower, about 8-fold lower, about 9-fold lower, at least about 10-fold lower, at least about 15-fold lower, at least about 20-fold lower, at least about 25-fold lower, at least about 30-fold lower, at least about 35-fold lower, at least about 40-fold lower, at least about 45-fold lower, at least about 50-fold lower, at least about 100-fold lower, at least about 150-fold lower, or about 10-50-fold lower, about 50-100-fold lower, about 100-150-fold lower, about 150-200-fold lower, or more than 200-fold lower relative to the wild type IFN-γ.

In various embodiments, the modified IFN-γ comprises one or more mutations that reduce the endogenous activity of the IFN-γ to about 75%, or about 70%, or about 60%, or about 50%, or about 40%, or about 30%, or about 25%, or about 20%, or about 10%, or about 5%, or about 3%, or about 1%, e.g., relative to the wild type IFN-γ.

In some embodiments, the modified IFN-γ comprises one or more mutations that cause the modified IFN-γ to have reduced affinity and/or biological activity for a receptor. In some embodiments, the modified IFN-γ's binding affinity and/or biological activity for a receptor is lower than the binding affinity and/or biological activity of the targeting moiety for its receptor. In some embodiments, this binding affinity and/or biological activity differential is between the modified IFN-γ/receptor and targeting moiety/receptor on the same cell. In some embodiments, this binding affinity and/or biological activity, differential allows for the modified IFN-γ to have localized, on-target effects and to minimize off-target effects that underlie side effects that are observed with wild type IFN-γ. In some embodiments, this binding affinity and/or biological activity is at least about 2-fold, or at least about 5-fold, or at least about 10-fold, or at least about 15-fold lower, or at least about 25-fold, or at least about 50-fold lower, or at least about 100-fold, or at least about 150-fold less.

Receptor binding activity may be measured using methods known in the art. For example, affinity and/or binding activity may be assessed by Scatchard plot analysis and computer-fitting of binding data (e.g., Scatchard, 1949) or by reflectometric interference spectroscopy under flow through conditions, as described by Brecht et al. (1993), the entire contents of all of which are hereby incorporated by reference.

In some embodiments, the modified signaling agent is a consensus interferon. The consensus interferon is generated by scanning the sequences of several human non-allelic IFN-α subtypes and assigning the most frequently observed amino acid in each corresponding position. The consensus interferon differs from IFN-α2b at 20 out of 166 amino acids (88% homology), and comparison with IFN-β3 shows identity at over 30% of the amino acid positions. In various embodiments, the consensus interferon comprises the following amino acid sequence of SEQ ID NO:49.

In some embodiments, the consensus interferon comprises the amino acid sequence of SEQ ID NO: 50, which differs from the amino acid sequence of SEQ ID NO: 49 by one amino acid, i.e., SEQ ID NO: 50 lacks the initial methionine residue of SEQ ID NO: 49.

In various embodiments, the consensus interferon comprises a modified version of the consensus interferon, i.e., a consensus interferon variant, as a signaling agent. In various embodiments, the consensus interferon variant encompasses functional derivatives, analogs, precursors, isoforms, splice variants, or fragments of the consensus interferon.

In an embodiment, the consensus interferon variants are selected form the consensus interferon variants disclosed in U.S. Pat. Nos. 4,695,623, 4,897,471, 5,541,293, and 8,496,921, the entire contents of all of which are hereby incorporated by reference. For example, the consensus interferon variant may comprise the amino acid sequence of IFN-CON$_2$ or IFN-CON$_3$ as disclosed in U.S. Pat. Nos. 4,695,623, 4,897,471, and 5,541,293. In an embodiment, the consensus interferon variant comprises the amino acid sequence of IFN-CON$_2$ (SEQ ID NO:51).

In an embodiment, the consensus interferon variant comprises the amino acid sequence of IFN-CON$_3$ (SEQ ID NO:52).

In an embodiment, the consensus interferon variant comprises the amino acid sequence of any one of the variants disclosed in U.S. Pat. No. 8,496,921. For example, the consensus variant may comprise the amino acid sequence of SEQ ID NO:53.

In another embodiment, the consensus interferon variant may comprise the amino acid sequence of SEQ ID NO:54.

In some embodiments, the consensus interferon variant may be PEGylated, i.e., comprises a PEG moiety. In an embodiment, the consensus interferon variant may comprise a PEG moiety attached at the S156C position of SEQ ID NO:54.

In some embodiments, the engineered interferon is a variant of human IFN-α2a, with an insertion of Asp at approximately position 41 in the sequence Glu-Glu-Phe-Gly-Asn-Gln (SEQ ID NO: 275) to yield Glu-Glu-Phe-Asp-Gly-Asn-Gln (SEQ ID NO: 276) (which resulted in a renumbering of the sequence relative to IFN-α2a sequence) and the following mutations of Arg23Lys, Leu26Pro, Glu53Gln, Thr54Ala, Pro56Ser, Asp86Glu, Ile104Thr, Gly106Glu, Thr110Glu, Lys117Asn, Arg125Lys, and Lys136Thr. All embodiments herein that describe consensus interferons apply equally to this engineered interferon In various embodiments, the consensus interferon variant comprises an amino acid sequence having one or more amino acid mutations. In some embodiments, the one or more amino acid mutations may be independently selected from substitutions, insertions, deletions, and truncations.

In some embodiments, the amino acid mutations are amino acid substitutions, and may include conservative and/or non-conservative substitutions.

In various embodiments, the substitutions may also include non-classical amino acids (e.g. selenocysteine, pyrrolysine, N-formylmethionine β-alanine, GABA and δ-Aminolevulinic acid, 4-aminobenzoic acid (PABA), D-isomers of the common amino acids, 2,4-diaminobutyric acid, α-amino isobutyric acid, 4-aminobutyric acid, Abu, 2-amino butyric acid, γ-Abu, ε-Ahx, 6-amino hexanoic acid, Aib, 2-amino isobutyric acid, 3-amino propionic acid, ornithine, norleucine, norvaline, hydroxyproline, sarcosme, citrulline, homocitrulline, cysteic acid, t-butylglycine, t-butylalanine, phenylglycine, cyclohexylalanine, β-alanine, fluoro-amino acids, designer amino acids such as β methyl amino acids, C α-methyl amino acids, N α-methyl amino acids, and amino acid analogs in general).

In various embodiments, the consensus interferon is modified to have one or more mutations. In some embodiments, the mutations allow for the consensus interferon variant to have one or more of attenuated activity such as one or more of reduced binding affinity, reduced endogenous activity, and reduced specific bioactivity relative to unmutated, e.g., the wild type form of the consensus interferon (e.g., the consensus interferon having an amino acid sequence of SEQ ID NO:49 or 50). For instance, the one or more of attenuated activity such as reduced binding affinity, reduced endogenous activity, and reduced specific bioactivity relative to unmutated, e.g. the wild type form of the consensus interferon, may be at a therapeutic receptor such as IFNAR. Consequentially, in various embodiments, the mutations allow for the consensus interferon variant to have reduced systemic toxicity, reduced side effects, and reduced off-target effects relative to unmutated, e.g. the wild type form of the consensus interferon.

In various embodiments, the consensus interferon is modified to have a mutation that reduces its binding affinity or activity at a therapeutic receptor such as IFNAR. In some embodiments, the activity provided by the consensus interferon is agonism at the therapeutic receptor (e.g. activation of a cellular effect at a site of therapy). For example, the consensus interferon may activate the therapeutic receptor. In such embodiments, the mutation results in the consensus interferon variant to have reduced activating activity at the therapeutic receptor.

In some embodiments, the reduced affinity or activity at the therapeutic receptor is restorable by attachment with a targeting moiety (e.g., Clec4C). In other embodiments, the reduced affinity or activity at the therapeutic receptor is not substantially restorable by attachment with the targeting moiety. In various embodiments, the therapeutic chimeric proteins or chimeric protein complexes of the present invention reduce off-target effects because the consensus interferon variant has mutations that weaken binding affinity or activity at a therapeutic receptor. In various embodiments, this reduces side effects observed with, for example, the wild type consensus interferon. In various embodiments, the consensus interferon variant is substantially inactive en route to the site of therapeutic activity and has its effect substantially on specifically targeted cell types which greatly reduces undesired side effects.

In various embodiments, the consensus interferon variant has one or more mutations that cause the consensus interferon variant to have attenuated or reduced affinity, e.g. binding (e.g. $K_D$) and/or activation (measurable as, for example, $K_A$ and/or $EC_{50}$) for one or more therapeutic receptors. In various embodiments, the reduced affinity at the therapeutic receptor allows for attenuation of activity and/or signaling from the therapeutic receptor.

In various embodiments, the consensus interferon variant has one or more mutations that reduce its binding to or its affinity for the IFNAR1 subunit of IFNAR. In one embodiment, the consensus interferon variant has reduced affinity and/or activity at IFNAR1. In some embodiments, the consensus interferon variant has one or more mutations that reduce its binding to or its affinity for the IFNAR2 subunit of IFNAR. In some embodiments, the consensus interferon variant has one or more mutations that reduce its binding to or its affinity for both IFNAR1 and IFNAR2 subunits.

In some embodiments, the consensus interferon variant has one or more mutations that reduce its binding to or its affinity for IFNAR1 and one or more mutations that substantially reduce or ablate binding to or its affinity for IFNAR2. In some embodiments, chimeric proteins or chimeric protein complexes with such consensus interferon variant can provide target-selective IFNAR1 activity (e.g. IFNAR1 activity is restorable via targeting through the targeting moiety, e.g., Clec4C).

In some embodiments, the consensus interferon variant has one or more mutations that reduce its binding to or its affinity for IFNAR2 and one or more mutations that substantially reduce or ablate binding to or its affinity for IFNAR1. In some embodiments, chimeric proteins or chimeric protein complexes with such consensus interferon variant can provide target-selective IFNAR2 activity (e.g. IFNAR2 activity is restorable via targeting through the targeting moiety, e.g., Clec4C).

In some embodiments, the consensus interferon variant has one or more mutations that reduce its binding to or its affinity for IFNAR1 and one or more mutations that reduce its binding to or its affinity for IFNAR2. In some embodiments, chimeric proteins or chimeric protein complexes with such consensus interferon variant can provide target-selective IFNAR1 and/or IFNAR2 activity (e.g. IFNAR1 and/IFNAR2 activity is restorable via targeting through the targeting moiety, e.g., Clec4C).

In some embodiments, the consensus interferon is modified to have a mutation at one or more amino acids at positions 145-155, such as amino acid positions 149, 150 and/or 154, with reference to SEQ ID NO: 50. In some embodiments, the consensus interferon is modified to have a mutation at one or more amino acids at positions 145-155, such as amino acid positions 149, 150 and/or 154, with reference to SEQ ID NO: 50, the substitutions optionally being hydrophobic and selected from alanine, valine, leucine, and isoleucine. In some embodiments, the consensus interferon mutant comprises one or more mutations selected from M149A, R150A, and L154A, and, with reference to SEQ ID NO: 50.

In an embodiment, the consensus interferon is modified to have a mutation at amino acid position 121 (i.e., K121), with reference to SEQ ID NO: 50. In an embodiment, the consensus interferon comprises a K121E mutation, with reference to SEQ ID NO: 50.

In various embodiments, the modified signaling agent is selected from modified versions of cytokines, growth factors, and hormones. Illustrative examples of such cytokines, growth factors, and hormones include, but are not limited to, lymphokines, monokines, traditional polypeptide hormones, such as human growth hormone, N-methionyl human growth hormone, and bovine growth hormone; parathyroid hormone; thyroxine; insulin; proinsulin; relaxin; prorelaxin; glycoprotein hormones such as follicle stimulating hormone (FSH), thyroid stimulating hormone (TSH), and luteinizing hormone (LH); hepatic growth factor; fibroblast growth factor; prolactin; placental lactogen; tumor necrosis factor-α and tumor necrosis factor-β; mullerian-inhibiting substance; mouse gonadotropin-associated peptide; inhibin; activin; vascular endothelial growth factor; integrin; thrombopoietin (TPO); nerve growth factors such as NGF-α; platelet-growth factor; transforming growth factors (TGFs) such as TGF-α and TGF-β; insulin-like growth factor-I and -II; osteo inductive factors; interferons such as, for example, interferon-α, interferon-β and interferon-γ (and interferon type I, II, and III), colony stimulating factors (CSFs) such as macrophage-CSF (M-CSF); granulocyte-macrophage-CSF (GM-CSF); and granulocyte-CSF (G-CSF); interleukins (ILs) such as, for example, IL-1, IL-1α, IL-2, IL-3, IL-4, IL-5, IL-6, IL-7, IL-8, IL-9, IL-10, IL-11, IL-12, IL-13, and IL-18; a tumor necrosis factor such as, for example, TNF-α or TNF-β; and other polypeptide factors including, for example, LIF and kit ligand (KL). As used herein, cytokines, growth factors, and hormones include proteins obtained from natural sources or produced from recombinant bacterial, eukaryotic or mammalian cell culture systems and biologically active equivalents of the native sequence cytokines.

In some embodiments, the modified signaling agent is a modified version of a growth factor selected from, but not limited to, transforming growth factors (TGFs) such as TGF-α and TGF-β (and subtypes thereof including the various subtypes of TGF-β including TGFβ1, TGFβ2, and TGFβ3), epidermal growth factor (EGF), insulin-like growth factor such as insulin-like growth factor-I and -II, fibroblast growth factor (FGF), heregulin, platelet-derived growth factor (PDGF), vascular endothelial growth factor (VEGF).

In an embodiment, the growth factor is a modified version of a fibroblast growth factor (FGF). Illustrative FGFs include, but are not limited to, FGF1, FGF2, FGF3, FGF4, FGF5, FGF6, FGF7, FGF8, FGF9, FGF10, FGF11, FGF12, FGF13, FGF14, murine FGF15, FGF16, FGF17, FGF18, FGF19, FGF20, FGF21, FGF22, and FGF23.

In some embodiments, the modified signaling agent is vascular endothelial growth factor (VEGF). VEGF is a potent growth factor that plays major roles in physiological but also pathological angiogenesis, regulates vascular permeability and can act as a growth factor on cells expressing VEGF receptors. Additional functions include, among others, stimulation of cell migration in macrophage lineage and endothelial cells. Several members of the VEGF family of growth factors exist, as well as at least three receptors (VEGFR-1, VEGFR-2, and VEGFR-3). Members of the VEGF family can bind and activate more than one VEGFR type. For example, VEGF-A binds VEGFR-1 and -2, while VEGF-C can bind VEGFR-2 and -3. VEGFR-1 and -2 activation regulates angiogenesis while VEGFR-3 activation is associated with lymphangiogenesis. The major pro-angiogenic signal is generated from activation of VEGFR-2. VEGFR-1 activation has been reported to be possibly associated with negative role in angiogenesis. It has also been reported that VEGFR-1 signaling is important for progression of tumors in vivo via bone marrow-derived VEGFR-1 positive cells (contributing to formation of premetastatic niche in the bone). Several therapies based on VEGF-A directed/neutralizing therapeutic antibodies have been developed, primarily for use in treatment of various human tumors relying on angiogenesis. These are not without side effects though. This may not be surprising considering that these operate as general, non-cell/tissue specific VEGF/VEGFR interaction inhibitors. Hence, it would be desirable to restrict VEGF (e.g. VEGF-A)/EGFR-2 inhibition to specific target cells (e.g. tumor vasculature endothelial cells).

In some embodiments, the VEGF is VEGF-A, VEGF-B, VEFG-C, VEGF-D, or VEGF-E and isoforms thereof including the various isoforms of VEGF-A such as $VEGF_{121}$, $VEGF_{121}$b, $VEGF_{145}$, $VEGF_{165}$, $VEGF_{165}$b, $VEGF_{189}$, and $VEGF_{206}$. In some embodiments, the modified signaling agent has reduced affinity and/or activity for VEGFR-1 (Flt-1) and/or VEGFR-2 (KDR/Flk-1). In some embodiments, the modified signaling agent has substantially reduced or ablated affinity and/or activity for VEGFR-1 (Flt-1) and/or VEGFR-2 (KDR/Flk-1). In an embodiment, the modified signaling agent has reduced affinity and/or activity for VEGFR-2 (KDR/Flk-1) and/or substantially reduced or ablated affinity and/or activity for VEGFR-1 (Flt-1). Such an embodiment finds use, for example, in wound healing methods or treatment of ischemia-related diseases (without wishing to be bound by theory, mediated by VEGFR-2's effects on endothelial cell function and angiogenesis). In various embodiments, binding to VEGFR-1 (Flt-1), which is linked to cancers and pro-inflammatory activities, is avoided. In various embodiments, VEGFR-1 (Flt-1) acts a decoy receptor and therefore substantially reduces or ablates affinity at this receptor avoids sequestration of the therapeutic agent. In an embodiment, the modified signaling agent has substantially reduced or ablated affinity and/or activity for VEGFR-1 (Flt-1) and/or substantially reduced or ablated affinity and/or activity for VEGFR-2 (KDR/Flk-1). In some embodiments, the VEGF is VEGF-C or VEGF-D. In such embodiments, the modified signaling agent has reduced affinity and/or activity for VEGFR-3. Alternatively, the modified signaling agent has substantially reduced or ablated affinity and/or activity for VEGFR-3.

Proangiogenic therapies are also important in various diseases (e.g. ischemic heart disease, bleeding etc.), and include VEGF-based therapeutics. Activation of VEGFR-2 is proangiogenic (acting on endothelial cells). Activation of VEFGR-1 can cause stimulation of migration of inflammatory cells (including, for example, macrophages) and lead to inflammation associated hypervascular permeability. Activation of VEFGR-1 can also promote bone marrow associated tumor niche formation. Thus, VEGF based therapeutic selective for VEGFR-2 activation would be desirable in this case. In addition, cell specific targeting, e.g. to endothelial cells, would be desirable.

In some embodiments, the modified signaling agent has reduced affinity and/or activity (e.g. antagonistic) for VEGFR-2 and/or has substantially reduced or ablated affinity and/or activity for VEGFR-1. When targeted to tumor vasculature endothelial cells via a targeting moiety that binds to a tumor endothelial cell marker (e.g. PSMA and others), such construct inhibits VEGFR-2 activation specifically on such marker-positive cells, while not activating VEGFR-1 en route and on target cells (if activity ablated), thus eliminating induction of inflammatory responses, for example. This would provide a more selective and safe anti-angiogenic therapy for many tumor types as compared to VEGF-A neutralizing therapies.

In some embodiments, the modified signaling agent has reduced affinity and/or activity (e.g. agonistic) for VEGFR-2 and/or has substantially reduced or ablated affinity and/or activity for VEGFR-1. Through targeting to vascular endothelial cells, such construct, in some embodiments, promotes angiogenesis without causing VEGFR-1 associated induction of inflammatory responses. Hence, such a construct would have targeted proangiogenic effects with substantially reduced risk of side effects caused by systemic activation of VEGFR-2 as well as VEGR-1.

In an illustrative embodiment, the modified signaling agent is $VEGF_{165}$, which has the amino acid sequence of SEQ ID NO:55).

In another illustrative embodiment, the modified signaling agent is $VEGF_{165b}$, which has the amino acid sequence of SEQ ID NO:56.

In these embodiments, the modified signaling agent has a mutation at amino acid 183 (e.g., a substitution mutation at 183, e.g., 183K, 183R, or 183H). Without wishing to be bound by theory, it is believed that such mutations may result in reduced receptor binding affinity. See, for example, U.S. Pat. No. 9,078,860, the entire contents of which are hereby incorporated by reference.

In some embodiments, the modified signaling agent is a modified version of a hormone selected from, but not limited to, human chorionic gonadotropin, gonadotropin releasing hormone, an androgen, an estrogen, thyroid-stimulating hormone, follicle-stimulating hormone, luteinizing hormone, prolactin, growth hormone, adrenocorticotropic hormone, antidiuretic hormone, oxytocin, thyrotropin-releasing hormone, growth hormone releasing hormone, corticotropin-releasing hormone, somatostatin, dopamine, melatonin, thyroxine, calcitonin, parathyroid hormone, glucocorticoids, mineralocorticoids, adrenaline, noradrenaline, progesterone, insulin, glucagon, amylin, calcitriol, calciferol, atrial-natriuretic peptide, gastrin, secretin, cholecystokinin, neuropeptide Y, ghrelin, PYY3-36, insulin-like growth factor (IGF), leptin, thrombopoietin, erythropoietin (EPO), and angiotensinogen.

In some embodiments, the modified signaling agent is TNF-α. TNF is a pleiotropic cytokine with many diverse functions, including regulation of cell growth, differentiation, apoptosis, tumorigenesis, viral replication, autoimmunity, immune cell functions and trafficking, inflammation, and septic shock. It binds to two distinct membrane receptors on target cells: TNFR1 (p55) and TNFR2 (p75). TNFR1 exhibits a very broad expression pattern whereas TNFR2 is expressed preferentially on certain populations of lymphocytes, Tregs, endothelial cells, certain neurons, microglia, cardiac myocytes and mesenchymal stem cells. Very distinct biological pathways are activated in response to receptor activation, although there is also some overlap. As a general rule, without wishing to be bound by theory, TNFR1 signaling is associated with induction of apoptosis (cell death) and TNFR2 signaling is associated with activation of cell survival signals (e.g. activation of NFkB pathway). Administration of TNF is systemically toxic, and this is largely due to TNFR1 engagement. However, it should be noted that activation of TNFR2 is also associated with a broad range of activities and, as with TNFR1, in the context of developing TNF based therapeutics, control over TNF targeting and activity is important.

In some embodiments, the modified signaling agent has reduced affinity and/or activity for TNFR1 and/or TNFR2. In some embodiments, the modified signaling agent has substantially reduced or ablated affinity and/or activity for TNFR1 and/or TNFR2. TNFR1 is expressed in most tissues, and is involved in cell death signaling while, by contrast, TNFR2 is involved in cell survival signaling. Accordingly, in embodiments directed to methods of treating cancer, the modified signaling agent has reduced affinity and/or activity for TNFR1 and/or substantially reduced or ablated affinity and/or activity for TNFR2. In these embodiments, the chimeric proteins or chimeric protein complexes may be targeted to a cell for which apoptosis is desired, e.g. a tumor cell or a tumor vasculature endothelial cell. In embodiments directed to methods of promoting cell survival, for example, in neurogenesis for the treatment of neurodegenerative disorders, the modified signaling agent has reduced affinity and/or activity for TNFR2 and/or substantially reduced or ablated affinity and/or activity for TNFR1. Stated another way, the present chimeric proteins or chimeric protein complexes, in some embodiments, comprise modified TNF-α agent that allows of favoring either death or survival signals.

In some embodiments, the chimeric protein or chimeric protein complex has a modified TNF having reduced affinity and/or activity for TNFR1 and/or substantially reduced or ablated affinity and/or activity for TNFR2. Such a chimera, in some embodiments, is a more potent inducer of apoptosis as compared to a wild type TNF and/or a chimera bearing only mutation(s) causing reduced affinity and/or activity for TNFR1. Such a chimera, in some embodiments, finds use in inducing tumor cell death or a tumor vasculature endothelial cell death (e.g. in the treatment of cancers). Also, in some embodiments, these chimeras avoid or reduce activation of $T_{reg}$ cells via TNFR2, for example, thus further supporting TNFR1-mediated antitumor activity in vivo.

In some embodiments, the chimeric protein or chimeric protein complex has a modified TNF having reduced affinity and/or activity for TNFR2 and/or substantially reduced or ablated affinity and/or activity for TNFR1. Such a chimera, in some embodiments, is a more potent activator of cell survival in some cell types, which may be a specific therapeutic objective in various disease settings, including without limitation, stimulation of neurogenesis. In addition, such a TNFR2-favoring chimeras also are useful in the treatment of autoimmune diseases (e.g. Crohn's, diabetes, MS, colitis etc. and many others described herein). In some embodiments, the chimera is targeted to auto-reactive T cells. In some embodiments, the chimera promotes $T_{reg}$ cell activation and indirect suppression of cytotoxic T cells.

In some embodiments, the chimera causes the death of auto-reactive T cells, e.g. by activation of TNFR2 and/or avoidance TNFR1 (e.g. a modified TNF having reduced affinity and/or activity for TNFR2 and/or substantially reduced or ablated affinity and/or activity for TNFR1). Without wishing to be bound by theory these auto-reactive T cells, have their apoptosis/survival signals altered e.g. by NFkB pathway activity/signaling alterations. In some embodiments, the chimera causes the death of autoreactive T cells having lesions or modifications in the NFκB pathway, which underlie an imbalance of their cell death (apoptosis)/survival signaling properties and, optionally, altered susceptibility to certain death-inducing signals (e.g., TNFR2 activation).

In some embodiments, a TNFR-2 based chimera has additional therapeutic applications in diseases, including autoimmune disease, various heart disease, de-myelinating and neurodegenerative disorders, and infectious disease, among others.

In an embodiment, the wild type TNF-α has the amino acid sequence of SEQ ID NO:57.

In such embodiments, the modified TNF-α agent has mutations at one or more amino acid positions 29, 31, 32, 84, 85, 86, 87, 88, 89, 145, 146 and 147 which produces a modified TNF-α with reduced receptor binding affinity. See, for example, U.S. Pat. No. 7,993,636, the entire contents of which are hereby incorporated by reference.

In some embodiments, the modified human TNF-α moiety has mutations at one or more amino acid positions R32, N34, Q67, H73, L75, T77, S86, Y87, V91, I97, T105, P106, A109, P113, Y115, E127, N137, D143, A145, and E146 as described, for example, in WO/2015/007903, the entire contents of which is hereby incorporated by reference (numbering according to the human TNF sequence, Genbank accession number BAG70306, version BAG70306.1 GI: 197692685). In some embodiments, the modified human TNF-α moiety has substitution mutations selected from L29S, R32G, R32W, N34G, Q67G, H73G, L75G, L75A, L75S, T77A, S86G, S86T, Y87Q, Y87L, Y87A, Y87F, Y87H, V91G, V91A, I97A, I97Q, I97S, T105G, P106G, A109Y, P113G, Y115G, Y115A, E127G, N137G, D143N, A145G, A145R, A145T, E146D, E146K, and S147D. In some embodiments, the human TNF-α moiety has a mutation selected from Y87Q, Y87L, Y87A, Y87F, and Y87H. In another embodiment, the human TNF-α moiety has a mutation selected from I97A, I97Q, and I97S. In a further embodiment, the human TNF-α moiety has a mutation selected from Y115A and Y115G. In some embodiments, the human TNF-α moiety has an E146K mutation. In some embodiments, the human TNF-α moiety has an Y87H and an E146K mutation. In some embodiments, the human TNF-α moiety has an Y87H and an A145R mutation. In some embodiments, the human TNF-α moiety has a R32W and a S86T mutation. In some embodiments, the human TNF-α moiety has a R32W and an E146K mutation. In some embodiments, the human TNF-α moiety has a L29S and a R32W mutation. In some embodiments, the human TNF-α moiety has a D143N and an A145R mutation. In some embodiments, the human TNF-α moiety has a D143N and an A145R mutation. In some embodiments, the human TNF-α moiety has an A145T, an E146D, and a S147D mutation. In some embodiments, the human TNF-α moiety has an A145T and a S147D mutation.

In some embodiments, the modified TNF-α agent has one or more mutations selected from N39Y, S147Y, and Y87H, as described in WO2008/124086, the entire contents of which is hereby incorporated by reference.

In some embodiments, the modified human TNF-α moiety has mutations that provide receptor selectivity as described in PCT/IB2016/001668, the entire contents of which are hereby incorporated by reference. In some embodiments, the mutations to TNF are TNF-R1 selective. In some embodiments, the mutations to TNF which are TNF-R1 selective are at one or more of positions R32, S86, and E146. In some embodiments, the mutations to TNF which are TNF-R1 selective are one or more of R32W, S86T, and E146K. In some embodiments, the mutations to TNF which are TNF-R1 selective are one or more of R32W, R32W/S86T, R32W/E146K and E146K.

In some embodiments, the mutations to TNF are TNF-R2 selective. In some embodiments, the mutations to TNF which are TNF-R2 selective are at one or more of positions A145, E146, and S147. In some embodiments, the mutations to TNF which are TNF-R2 selective are one or more of A145T, A145R, E146D, and S147D. In some embodiments, the mutations to TNF which are TNF-R2 selective are one or more of A145R, A145T/S147D, and A145T/E146D/S147D.

In an embodiment, the modified signaling agent is TNF-β. TNF-β can form a homotrimer or a heterotrimer with LT-β (LT-α1β2). In some embodiments, the modified signaling agent has substantially reduced or ablated affinity and/or activity for TNFR1 and/or TNFR2 and/or herpes virus entry mediator (HEVM) and/or LT-βR.

In an embodiment, the wild type TNF-β has the amino acid sequence of SEQ ID NO:58.

In such embodiments, the modified TNF-β agent may comprise mutations at one or more amino acids at positions 106-113, which produce a modified TNF-β with reduced receptor binding affinity to TNFR2. In an embodiment, the modified signaling agent has one or more substitution mutations at amino acid positions 106-113. In illustrative embodiments, the substitution mutations are selected from Q107E, Q107D, S106E, S106D, Q107R, Q107N, Q107E/S106E, Q107E/S106D, Q107D/S106E, and Q107D/S106D. In another embodiment, the modified signaling agent has an insertion of about 1 to about 3 amino acids at positions 106-113.

In some embodiments, the modified agent is a TNF family member (e.g. TNF-alpha, TNF-beta) which can be a single chain trimeric version as described in WO 2015/007903 and PCT/IB2016/001668, the entire contents of which are incorporated by reference.

In some embodiments, the modified agent is a TNF family member (e.g. TNF-alpha, TNF-beta) which has reduced affinity and/or activity, i.e. antagonistic activity (e.g. natural antagonistic activity or antagonistic activity that is the result of one or more mutations, see, e.g., WO 2015/007520, the entire contents of which are hereby incorporated by reference) at TNFR1. In these embodiments, the modified agent is a TNF family member (e.g. TNF-alpha, TNF-beta) which also, optionally, has substantially reduced or ablated affinity and/or activity for TNFR2. In some embodiments, the modified agent is a TNF family member (e.g. TNF-alpha, TNF-beta) which has reduced affinity and/or activity, i.e. antagonistic activity (e.g. natural antagonistic activity or antagonistic activity that is the result of one or more mutations, see, e.g., WO 2015/007520, the entire contents of which are hereby incorporated by reference) at TNFR2. In these embodiments, the modified agent is a TNF family member (e.g. TNF-alpha, TNF-beta) which also, optionally, has substantially reduced or ablated affinity and/or activity for TNFR1. The constructs of such embodiments find use in, for example, methods of dampening TNF response in a cell specific manner. In some embodiments, the antagonistic TNF family member (e.g. TNF-alpha, TNF-beta) is a single chain trimeric version as described in WO 2015/007903.

In an embodiment, the modified signaling agent is TRAIL. In some embodiments, the modified TRAIL agent has reduced affinity and/or activity for DR4 (TRAIL-RI) and/or DR5 (TRAIL-RII) and/or DcR1 and/or DcR2. In some embodiments, the modified TRAIL agent has substantially reduced or ablated affinity and/or activity for DR4 (TRAIL-RI) and/or DR5 (TRAIL-RII) and/or DcR1 and/or DcR2.

In an embodiment, the wild type TRAIL has the amino acid sequence of SEQ ID NO:59.

In such embodiments, the modified TRAIL agent may comprise a mutation at amino acid positions T127-R132, E144-R149, E155-H161, Y189-Y209, T214-1220, K224-A226, W231, E236-L239, E249-K251, T261-H264 and H270-E271 (Numbering based on the human sequence, Genbank accession number NP 003801, version 10 NP_003801.1, GI: 4507593; see above).

In some embodiments, the modified TRAIL agent may comprise one or more mutations that substantially reduce its affinity and/or activity for TRAIL-R1. In such embodiments, the modified TRAIL agent may specifically bind to TRIL-R2. Illustrative mutations include mutations at one or more amino acid positions Y189, R191, Q193, H264, 1266, and D267. For example, the mutations may be one or more of Y189Q, R191K, Q193R, H264R, 1266L and D267Q. In an embodiment, the modified TRAIL agent comprises the mutations Y189Q, R191K, Q193R, H264R, 1266L and D267Q.

In some embodiments, the modified TRAIL agent may comprise one or more mutations that substantially reduce its affinity and/or activity for TRAIL-R2. In such embodiments, the modified TRAIL agent may specifically bind to TRIL-R1. Illustrative mutations include mutations at one or more amino acid positions G131, R149, S159, N199, K201, and S215. For example, the mutations may be one or more of G131R, R1491, S159R, N199R, K201H, and S215D. In an embodiment, the modified TRAIL agent comprises the mutations G131R, R1491, S159R, N199R, K201H, and S215D. Additional TRAIL mutations are described in, for example, Trebing et al., (2014) Cell Death and Disease, 5:e1035, the entire disclosure of which is hereby incorporated by reference.

In an embodiment, the modified signaling agent is TGFα. In such embodiments, the modified TGFα agent has reduced affinity and/or activity for the epidermal growth factor receptor (EGFR). In some embodiments, the modified TGFα agent has substantially reduced or ablated affinity and/or activity for the epidermal growth factor receptor (EGFR).

In an embodiment, the modified signaling agent is TGFβ. In such embodiments, the modified signaling agent has reduced affinity and/or activity for TGFBR1 and/or TGFBR2. In some embodiments, the modified signaling agent has substantially reduced or ablated affinity and/or activity for TGFBR1 and/or TGFBR2. In some embodiments, the modified signaling agent optionally has reduced or substantially reduced or ablated affinity and/or activity for TGFBR3 which, without wishing to be bound by theory, may act as a reservoir of ligand for TGF-beta receptors. In some embodiments, the TGFβ may favor TGFBR1 over TGFBR2 or TGFBR2 over TGFBR1. Similarly, LAP, without wishing to be bound by theory, may act as a reservoir of ligand for TGF-beta receptors. In some embodiments, the modified signaling agent has reduced affinity and/or activity for TGFBR1 and/or TGFBR2 and/or substantially reduced or ablated affinity and/or activity for Latency Associated Peptide (LAP). In some embodiments, such chimeras find use in Camurati-Engelmann disease, or other diseases associated with inappropriate TGFβ signaling.

In some embodiments, the modified agent is a TGF family member (e.g. TGFα, TGFβ) which has reduced affinity and/or activity, i.e. antagonistic activity (e.g. natural antagonistic activity or antagonistic activity that is the result of one or more mutations, see, e.g., WO 2015/007520, the entire contents of which are hereby incorporated by reference) at one or more of TGFBR1, TGFBR2, TGFBR3. In these embodiments, the modified agent is a TGF family member (e.g. TGFα, TGFβ) which also, optionally, has substantially reduced or ablated affinity and/or activity at one or more of TGFBR1, TGFBR2, TGFBR3.

In some embodiments, the modified agent is a TGF family member (e.g. TGFα, TGFβ) which has reduced affinity and/or activity, i.e. antagonistic activity (e.g. natural antagonistic activity or antagonistic activity that is the result of one or more mutations, see, e.g., WO 2015/007520, the entire contents of which are hereby incorporated by reference) at TGFBR1 and/or TGFBR2. In these embodiments, the modified agent is a TGF family member (e.g. TGFα, TGFβ) which also, optionally, has substantially reduced or ablated affinity and/or activity at TGFBR3.

In an embodiment, the modified signaling agent is an interleukin. In an embodiment, the modified signaling agent is IL-1. In an embodiment, the modified signaling agent is IL-1α or IL-1β. In some embodiments, the modified signaling agent has reduced affinity and/or activity for IL-1R1 and/or IL-1RAcP. In some embodiments, the modified signaling agent has substantially reduced or ablated affinity and/or activity for IL-1R1 and/or IL-1RAcP. In some embodiments, the modified signaling agent has reduced affinity and/or activity for IL-1R2. In some embodiments, the modified signaling agent has substantially reduced or ablated affinity and/or activity for IL-1R2. For instance, in some embodiments, the present modified IL-1 agents avoid interaction at IL-1R2 and therefore substantially reduce its function as a decoy and/or sink for therapeutic agents.

In an embodiment, the wild type IL-1p has the amino acid sequence of SEQ ID NO:60.

IL1 is a proinflammatory cytokine and an important immune system regulator. It is a potent activator of CD4 T cell responses, increases proportion of Th17 cells and expansion of IFNγ and IL-4 producing cells. IL-1 is also a potent regulator of CD8⁺ T cells, enhancing antigen-specific CD8⁺ T cell expansion, differentiation, migration to periphery and memory. IL-1 receptors comprise IL-1R1 and IL-1R2. Binding to and signaling through the IL-1R1 constitutes the mechanism whereby IL-1 mediates many of its biological (and pathological) activities. IL1-R2 can function as a decoy receptor, thereby reducing IL-1 availability for interaction and signaling through the IL-1R1.

In some embodiments, the modified IL-1 has reduced affinity and/or activity (e.g. agonistic activity) for IL-1R1. In some embodiments, the modified IL-1 has substantially reduced or ablated affinity and/or activity for IL-1R2. In such embodiments, there is restorable IL-1/IL-1R1 signaling and prevention of loss of therapeutic chimeras at IL-R2 and therefore a reduction in dose of IL-1 that is required (e.g. relative to wild type or a chimera bearing only an attenuation mutation for IL-R1). Such constructs find use in, for example, methods of treating cancer, including, for example, stimulating the immune system to mount an anti-cancer response.

In some embodiments, the modified IL-1 has reduced affinity and/or activity (e.g. antagonistic activity, e.g. natural antagonistic activity or antagonistic activity that is the result of one or more mutations, see, e.g., WO 2015/007520, the entire contents of which are hereby incorporated by reference) for IL-1R1. In some embodiments, the modified IL-1 has substantially reduced or ablated affinity and/or activity for IL-1R2. In such embodiments, there is the IL-1/IL-1R1 signaling is not restorable and prevention of loss of therapeutic chimeras at IL-R2 and therefore a reduction in dose of IL-1 that is required (e.g. relative to wild type or a chimera bearing only an attenuation mutation for IL-R1). Such constructs find use in, for example, methods of treating autoimmune diseases, including, for example, suppressing the immune system.

In such embodiments, the modified signaling agent has a deletion of amino acids 52-54 which produces a modified human IL-1β with reduced binding affinity for type I IL-1R and reduced biological activity. See, for example, WO 1994/000491, the entire contents of which are hereby incorporated by reference. In some embodiments, the modified human IL-1β has one or more substitution mutations selected from A117G/P118G, R120X, L122A, T125G/L126G, R127G, Q130X, Q131G, K132A, S137G/Q138Y, L145G, H146X, L145A/L147A, Q148X, Q148G/Q150G, Q150G/D151A, M152G, F162A, F162A/Q164E, F166A, Q164E/E167K, N169G/D170G, I172A, V174A, K208E, K209X, K209A/K210A, K219X, E221X, E221 S/N224A, N224S/K225S, E244K, N245Q (where X can be any change in amino acid, e.g., a non-conservative change), which exhibit reduced binding to IL-1R, as described, for example, in WO2015/007542 and WO/2015/007536, the entire contents of which is hereby incorporated by reference (numbering base on the human IL-1β sequence, Genbank accession number NP_000567, version NP-000567.1, GI: 10835145). In some embodiments, the modified human IL-1β may have one or more mutations selected from R120A, R120G, Q130A, Q130W, H146A, H146G, H146E, H146N, H146R, Q148E, Q148G, Q148L, K209A, K209D, K219S, K219Q, E221S and E221K. In an embodiment, the modified human IL-1β comprises the mutations Q131G and Q148G. In an embodiment, the modified human IL-1β comprises the mutations Q148G and K208E. In an embodiment, the modified human IL-1β comprises the mutations R120G and Q131G. In an embodiment, the modified human IL-1β comprises the mutations R120G and H146A. In an embodiment, the modified human IL-1β comprises the mutations R120G and H146N. In an embodiment, the modified human IL-1β comprises the mutations R120G and H146R. In an embodiment, the modified human IL-1β comprises the mutations R120G and H146E. In an embodiment, the modified human IL-1β comprises the mutations R120G and H146G. In an embodiment, the modified human IL-1β comprises the mutations R120G and K208E. In an embodiment, the modified human IL-1β comprises the mutations R120G, F162A, and Q164E.

In an embodiment, the modified signaling agent is IL-2. In such an embodiment, the modified signaling agent has reduced affinity and/or activity for IL-2Rα and/or IL-2Rβ and/or IL-2Rγ. In some embodiments, the modified signaling agent has reduced affinity and/or activity for IL-2Rβ and/or IL-2Rγ. In some embodiments, the modified signaling agent has substantially reduced or ablated affinity and/or activity for IL-2Rα. Such embodiments may be relevant for treatment of cancer, for instance when the modified IL-2 is agonistic at IL-2Rβ and/or IL-2Rγ. For instance, the present constructs may favor attenuated activation of CD8+ T cells (which can provide an anti-tumor effect), which have IL2 receptors β and γ and disfavor $T_{regs}$ (which can provide an immune suppressive, pro-tumor effect), which have IL2 receptors α, β, and γ. Further, in some embodiments, the preferences for IL-2Rβ and/or IL-2Rγ over IL-2Rα avoid IL-2 side effects such as pulmonary edema. Also, IL-2-based chimeras are useful for the treatment of diseases (e.g., autoimmune disease), for instance when the modified IL-2 is antagonistic (e.g. natural antagonistic activity or antagonistic activity that is the result of one or more mutations, see, e.g., WO 2015/007520, the entire contents of which are hereby incorporated by reference) at IL-2Rβ and/or IL-2Rγ. For instance, the present constructs may favor attenuated suppression of CD8+ T cells (and therefore dampen the immune response), which have IL2 receptors β and γ and disfavor $T_{regs}$ which have IL2 receptors α, β, and γ. Alternatively, in some embodiments, the chimeras bearing IL-2 favor the activation of $T_{regs}$, and therefore induce immune suppression, and activation of disfavor of CD8+ T cells. For instance, these constructs find use in the treatment of diseases or diseases that would benefit from immune suppression, e.g., autoimmune disorders.

In some embodiments, the chimeric protein or chimeric protein complex has targeting moieties as described herein directed to CD8+ T cells as well as a modified IL-2 agent having reduced affinity and/or activity for IL-2Rβ and/or IL-2Rγ and/or substantially reduced or ablated affinity and/or activity for IL-2Rα. In some embodiments, these constructs provide targeted CD8+ T cell activity and are generally inactive (or have substantially reduced activity) towards $T_{reg}$ cells. In some embodiments, such constructs have enhanced immune stimulatory effect compared to wild type IL-2 (e.g., without wishing to be bound by theory, by not stimulating Tregs), whilst eliminating or reducing the systemic toxicity associated with IL-2.

In an embodiment, the wild type IL-2 has the amino acid sequence of SEQ ID NO:61.

In such embodiments, the modified IL-2 agent has one or more mutations at amino acids L72 (L72G, L72A, L72S, L72T, L72Q, L72E, L72N, L72D, L72R, or L72K), F42 (F42A, F42G, F42S, F42T, F42Q, F42E, F42N, F42D, F42R, or F42K) and Y45 (Y45A, Y45G, Y45S, Y45T, Y45Q, Y45E, Y45N, Y45D, Y45R or Y45K). Without wishing to be bound by theory, it is believed that these modified IL-2 agents have reduced affinity for the high-affinity IL-2 receptor and preserves affinity to the intermediate-affinity IL-2 receptor, as compared to the wild-type IL-2. See, for example, US Patent Publication No. 2012/0244112, the entire contents of which are hereby incorporated by reference.

In some embodiments, the modified IL-2 agent has one or more mutations at amino acids R38, F42, Y45, and E62. For example, the modified IL-2 agent may comprise one or more of R38A, F42A, Y45A, and E62A. In some embodiments, the modified IL-2 agent may comprise a mutation at C125. For example, the mutation may be C125S. In such embodiments, the modified IL-2 agent may have substantially reduced affinity and/or activity for IL-2Rα, as described in, for example, Carmenate et al. (2013) The Journal of Immunology, 190:6230-6238, the entire disclosure of which is hereby incorporated by reference. In some embodiments, the modified IL-2 agent with mutations at R38, F42, Y45, and/or E62 is able to induce an expansion of effector cells including CD8⁺ T cells and NK cells but not Treg cells. In some embodiments, the modified IL-2 agent with mutations at R38, F42, Y45, and/or E62 is less toxic than wildtype IL-2 agents. A chimeric protein or chimeric protein complex comprising the modified IL-2 agent with substantially reduced affinity and/or activity for IL-2Rα may find application in oncology for example.

In other embodiments, the modified IL-2 agent may have substantially reduced affinity and/or activity for IL-2Rβ, as described in, for example, WO2016/025385, the entire disclosure of which is hereby incorporated by reference. In such embodiments, the modified IL-2 agent may induce an expansion of Treg cells but not effector cells such as CD8⁺ T cells and NK cells. A chimeric protein or chimeric protein complex comprising the modified IL-2 agent with substantially reduced affinity and/or activity for IL-2Rβ may find application in the treatment of autoimmune disease for example. In some embodiments, the modified IL-2 agent may comprise one or more mutations at amino acids N88, D20, and/r A126. For example, the modified IL-2 agent may comprise one or more of N88R, N88I, N88G, D20H, Q126L, and Q126F.

In various embodiments, the modified IL-2 agent may comprise a mutation at D109 or C125. For example, the mutation may be D109C or C125S. In some embodiments, the modified IL-2 with a mutation at D109 or C125 may be utilized for attachment to a PEG moiety.

In an embodiment, the modified signaling agent is IL-3. In some embodiments, the modified signaling agent has reduced affinity and/or activity for the IL-3 receptor, which is a heterodimer with a unique alpha chain paired with the common beta (beta c or CD131) subunit. In some embodiments, the modified signaling agent has substantially reduced or ablated affinity and/or activity for the IL-3 receptor, which is a heterodimer with a unique alpha chain paired with the common beta (beta c or CD131) subunit.

In an embodiment, the modified signaling agent is IL-4. In such an embodiment, the modified signaling agent has reduced affinity and/or activity for type 1 and/or type 2 IL-4 receptors. In such an embodiment, the modified signaling agent has substantially reduced or ablated affinity and/or activity for type 1 and/or type 2 IL-4 receptors. Type 1 IL-4 receptors are composed of the IL-4Rα subunit with a common γ chain and specifically bind IL-4. Type 2 IL-4 receptors include an IL-4Rα subunit bound to a different subunit known as IL-13Rα1. In some embodiments, the modified signaling agent has substantially reduced or ablated affinity and/or activity the type 2 IL-4 receptors.

In an embodiment, the wild type IL-4 has the amino acid sequence of SEQ ID NO:62.

In such embodiments, the modified IL-4 agent has one or more mutations at amino acids R121 (R121A, R121D, R121E, R121F, R121H, R1211, R121K, R121N, R121P, R121T, R121W), E122 (E122F), Y124 (Y124A, Y124Q, Y124R, Y124S, Y124T) and S125 (S125A). Without wishing to be bound by theory, it is believed that these modified IL-4 agents maintain the activity mediated by the type I receptor, but significantly reduces the biological activity mediated by the other receptors. See, for example, U.S. Pat. No. 6,433,157, the entire contents of which are hereby incorporated by reference.

In an embodiment, the modified signaling agent is IL-6. IL-6 signals through a cell-surface type I cytokine receptor complex including the ligand-binding IL-6R chain (CD126), and the signal-transducing component gp130. IL-6 may also bind to a soluble form of IL-6R (sIL-6R), which is the extracellular portion of IL-6R. The sIL-6R/IL-6 complex may be involved in neurites outgrowth and survival of neurons and, hence, may be important in nerve regeneration through remyelination. Accordingly, in some embodiments, the modified signaling agent has reduced affinity and/or activity for IL-6R/gp130 and/or sIL-6R. In some embodiments, the modified signaling agent has substantially reduced or ablated affinity and/or activity for IL-6R/gp130 and/or sIL-6R.

In an embodiment, the wild type IL-6 has the amino acid sequence of SEQ ID NO:63.

In such embodiments, the modified signaling agent has one or more mutations at amino acids 58, 160, 163, 171 or 177. Without wishing to be bound by theory, it is believed that these modified IL-6 agents exhibit reduced binding affinity to IL-6Ralpha and reduced biological activity. See, for example, WO 97/10338, the entire contents of which are hereby incorporated by reference.

In an embodiment, the modified signaling agent is IL-10. In such an embodiment, the modified signaling agent has reduced affinity and/or activity for IL-10 receptor-1 and IL-10 receptor-2. In some embodiments, the modified signaling agent has substantially reduced or ablated affinity and/or activity for IL-10 receptor-1 and IL-10 receptor-2

In an embodiment, the modified signaling agent is IL-11. In such an embodiment, the modified signaling agent has reduced affinity and/or activity for IL-11Rα and/or IL-11Rβ and/or gp130. In such an embodiment, the modified signaling agent has substantially reduced or ablated affinity and/or activity for IL-11Rα and/or IL-11Rβ and/or gp130.

In an embodiment, the modified signaling agent is IL-12. In such an embodiment, the modified signaling agent has reduced affinity and/or activity for IL-12Rβ1 and/or IL-12Rβ2. In such an embodiment, the modified signaling agent has substantially reduced or ablated affinity and/or activity for IL-12Rβ1 and/or IL-12Rβ2.

In an embodiment, the modified signaling agent is IL-13. In such an embodiment, the modified signaling agent has reduced affinity and/or activity for the IL-4 receptor (IL-4Rα) and IL-13Rα1. In some embodiments, the modified signaling agent has substantially reduced or ablated affinity and/or activity for IL-4 receptor (IL-4Rα) or IL-13Rα1.

In an embodiment, the wild type IL-13 has the amino acid sequence of SEQ ID NO:64.

In such embodiments, the modified IL-13 agent has one or more mutations at amino acids 13, 16, 17, 66, 69, 99, 102, 104, 105, 106, 107, 108, 109, 112, 113 and 114. Without wishing to be bound by theory, it is believed that these modified IL-13 agents exhibit reduced biological activity. See, for example, WO 2002/018422, the entire contents of which are hereby incorporated by reference.

In an embodiment, the modified signaling agent is IL-18. In some embodiments, the modified signaling agent has reduced affinity and/or activity for IL-18Rα and/or IL-18Rβ. In some embodiments, the modified signaling agent has substantially reduced or ablated affinity and/or activity for IL-18Rα and/or IL-18Rβ. In some embodiments, the modified signaling agent has substantially reduced or ablated affinity and/or activity for IL-18Rα type II, which is an isoform of IL-18Rα that lacks the TIR domain required for signaling.

In an embodiment, the wild type IL-18 has the amino acid sequence of SEQ ID NO:65.

In such embodiments, the modified IL-18 agent may comprise one or more mutations in amino acids or amino acid regions selected from Y37-K44, R49-Q54, D59-R63, E67-C74, R80, M87-A97, N 127-K129, Q139-M149, K165-K171, R183 and Q190-N191, as described in WO/2015/007542, the entire contents of which are hereby incorporated by reference (numbering based on the human IL-18 sequence, Genbank accession number AAV38697, version AAV38697.1, GI: 54696650).

In an embodiment, the modified signaling agent is IL-33. In such an embodiment, the modified signaling agent has reduced affinity and/or activity for the ST-2 receptor and IL-1RAcP. In some embodiments, the modified signaling agent has substantially reduced or ablated affinity and/or activity for the ST-2 receptor and IL-1RAcP.

In an embodiment, the wild type IL-33 has the amino acid sequence of SEQ ID NO:66.

In such embodiments, the modified IL-33 agent may comprise one or more mutations in amino acids or amino acid regions selected from I113-Y122, S127-E139, E144-D157, Y163-M183, E200, Q215, L220-C227 and T260-E269, as described in WO/2015/007542, the entire contents of which are hereby incorporated by reference (numbering based on the human sequence, Genbank accession number NP_254274, version NP_254274.1, GI:15559209).

In an embodiment, the modified signaling agent is epidermal growth factor (EGF). EGF is a member of a family of potent growth factors. Members include EGF, HB-EGF, and others such as TGFalpha, amphiregulin, neuregulins, epiregulin, betacellulin. EGF family receptors include EGFR (ErbB1), ErbB2, ErbB3 and ErbB4. These may function as homodimeric and/or heterodimeric receptor subtypes. The different EGF family members exhibit differential selectivity for the various receptor subtypes. For example, EGF associates with ErbB1/ErbB1, ErbB1/ErbB2, ErbB4/ErbB2 and some other heterodimeric subtypes. HB-EGF has a similar pattern, although it also associates with ErbB4/4. Modulation of EGF (EGF-like) growth factor signaling, positively or negatively, is of considerable therapeutic interest. For example, inhibition of EGFRs signaling is of interest in the treatment of various cancers where EGFR signaling constitutes a major growth promoting signal. Alternatively, stimulation of EGFRs signaling is of therapeutic interest in, for example, promoting wound healing (acute and chronic), oral mucositis (a major side-effect of various cancer therapies, including, without limitation radiation therapy).

In some embodiments, the modified signaling agent has reduced affinity and/or activity for ErbB1, ErbB2, ErbB3, and/or ErbB4. Such embodiments find use, for example, in methods of treating wounds. In some embodiments, the modified signaling agent binds to one or more ErbB1, ErbB2, ErbB3, and ErbB4 and antagonizes the activity of the receptor. In such embodiments, the modified signaling agent has reduced affinity and/or activity for ErbB1, ErbB2, ErbB3, and/or ErbB4 which allows for the activity of the receptor to be antagonized in an attenuated fashion. Such embodiments find use in, for example, treatments of cancer. In an embodiment, the modified signaling agent has reduced affinity and/or activity for ErbB1. ErbB1 is the therapeutic target of kinase inhibitors—most have side effects because they are not very selective (e.g., gefitinib, erlotinib, afatinib, brigatinib and icotinib). In some embodiments, attenuated antagonistic ErbB1 signaling is more on-target and has less side effects than other agents targeting receptors for EGF.

In some embodiments, the modified signaling agent has reduced affinity and/or activity (e.g. antagonistic e.g. natural antagonistic activity or antagonistic activity that is the result of one or more mutations, see, e.g., WO 2015/007520, the entire contents of which are hereby incorporated by reference) for ErbB1 and/or substantially reduced or ablated affinity and/or activity for ErbB4 or other subtypes it may interact with. Through specific targeting via the targeting moiety, cell-selective suppression (antagonism e.g. natural antagonistic activity or antagonistic activity that is the result of one or more mutations, see, e.g., WO 2015/007520, the entire contents of which are hereby incorporated by reference) of ErbB1/ErbB1 receptor activation would be achieved—while not engaging other receptor subtypes potentially associated with inhibition-associated side effects. Hence, in contrast to EGFR kinase inhibitors, which inhibit EGFR activity in all cell types in the body, such a construct would provide a cell-selective (e.g., tumor cell with activated EGFR signaling due to amplification of receptor, overexpression etc.) anti-EGFR (ErbB1) drug effect with reduced side effects.

In some embodiments, the modified signaling agent has reduced affinity and/or activity (e.g. agonistic) for ErbB4 and/or other subtypes it may interact with. Through targeting to specific target cells through the targeting moiety, a selective activation of ErbB1 signaling is achieved (e.g. epithelial cells). Such a construct finds use, in some embodiments, in the treatment of wounds (promoting would healing) with reduced side effects, especially for treatment of chronic conditions and application other than topical application of a therapeutic (e.g. systemic wound healing).

In an embodiment, the modified signaling agent is insulin or insulin analogs. In some embodiments, the modified insulin or insulin analog has reduced affinity and/or activity for the insulin receptor and/or IGF1 or IGF2 receptor. In some embodiments, the modified insulin or insulin analog has substantially reduced or ablated affinity and/or activity for the insulin receptor and/or IGF1 or IGF2 receptor. Attenuated response at the insulin receptor allows for the control of diabetes, obesity, metabolic disorders and the like while directing away from IGF1 or IGF2 receptor avoids pro-cancer effects.

In an embodiment, the modified signaling agent is insulin-like growth factor-I or insulin-like growth factor-II (IGF-1 or IGF-2). In an embodiment, the modified signaling agent is IGF-1. In such an embodiment, the modified signaling agent has reduced affinity and/or activity for the insulin receptor and/or IGF1 receptor. In an embodiment, the modified signaling agent may bind to the IGF1 receptor and antagonize the activity of the receptor. In such an embodiment, the modified signaling agent has reduced affinity and/or activity for IGF1 receptor which allows for the activity of the receptor to be antagonized in an attenuated fashion. In some embodiments, the modified signaling agent has substantially reduced or ablated affinity and/or activity for the insulin receptor and/or IGF1 receptor. In some embodiments, the modified signaling agent has reduced affinity and/or activity for IGF2 receptor which allows for the activity of the receptor to be antagonized in an attenuated fashion. In an embodiment, the modified signaling agent has substantially reduced or ablated affinity and/or activity for the insulin receptor and accordingly does not interfere with insulin signaling. In various embodiments, this applies to cancer treatment. In various embodiments, the present agents may prevent IR isoform A from causing resistance to cancer treatments.

In one embodiment, the present chimeric protein or chimeric protein complex has (i) a targeting moiety against Clec4C and (ii) a targeting moiety which is directed against a tumor cell, along with any of the modified or mutant signaling agents described herein. In an embodiment, the present chimeric protein or chimeric protein complex has a targeting moiety directed against Clec4C on dendritic cells and a second targeting moiety directed against PD-L1 or PD-L2 on tumor cells.

In one embodiment, the present chimeric protein or chimeric protein complex has (i) a targeting moiety against Clec4C and (ii) a targeting moiety which is directed against a checkpoint inhibitor marker, along with any of the modified or mutant interferons described herein. In an embodiment, the present chimeric protein or chimeric protein complex has a targeting moiety directed against Clec4C on dendritic cells and a second targeting moiety directed against PD-1.

In various embodiments, the signaling agent is a toxin or toxic enzyme. In some embodiments, the toxin or toxic enzyme is derived from plants and bacteria. Illustrative toxins or toxic enzymes include, but are not limited to, the diphtheria toxin, Pseudomonas toxin, anthrax toxin, ribosome-inactivating proteins (RIPs) such as ricin and saporin, modeccin, abrin, gelonin, and poke weed antiviral protein. Additional toxins include those disclosed in Mathew et al., (2009) Cancer Sci 100(8): 1359-65, the entire disclosures are hereby incorporated by reference. In such embodiments, the chimeric proteins or chimeric protein complexes of the invention may be utilized to induce cell death in cell-type specific manner. In such embodiments, the toxin may be modified, e.g. mutated, to reduce affinity and/or activity of the toxin for an attenuated effect, as described with other signaling agents herein.

Multi-Specific Chimeras and Fusions with Signaling Agents

In various embodiments, the chimeric protein or chimeric protein complex of the invention comprises one or more signaling agents as described herein and/or one or more additional targeting moieties (i.e., in addition to the targeting moiety directed against Clec4C). Accordingly, the present invention provides for chimeric or fusion proteins that include one or more signaling agents, a targeting moiety against Clec4C, and/or one or more additional targeting moieties.

In various embodiments, the chimeric proteins or chimeric protein complexes of the present invention have targeting moieties which target two different cells (e.g. to make a synapse) or the same cell (e.g. to get a more concentrated signaling agent effect).

In various embodiments, the chimeric protein or chimeric protein complex of the invention is multispecific, i.e., the chimeric protein or chimeric protein complex comprises two or more targeting moieties having recognition domains (e.g. antigen recognition domains) that recognize and bind two or more targets (e.g. antigens, or receptors, or epitopes). In such embodiments, the chimeric protein or chimeric protein complex of the invention may comprise two more targeting moieties having recognition domains that recognize and bind two or more epitopes on the same antigen or on different antigens or on different receptors. In various embodiments, such multi-specific chimeric proteins or chimeric protein complexes exhibit advantageous properties such as increased avidity and/or improved selectivity. In an embodiment, the chimeric protein or chimeric protein complex of the invention comprises two targeting moieties and is bispecific, i.e., binds and recognizes two epitopes on the same antigen or on different antigens or different receptors.

In various embodiments, the multispecific chimeric protein or chimeric protein complex of the invention comprises two or more targeting moieties with each targeting moiety being an antibody or an antibody derivative as described herein. In an illustrative embodiment, the multispecific chimeric protein or chimeric protein complex of the invention comprises at least one antibody or antibody derivative (e.g., a VHH) comprising an antigen recognition domain against Clec4C and one antibody or antibody derivative comprising a recognition domain against a tumor antigen. In an illustrative embodiment, the multispecific chimeric protein or chimeric protein complex of the invention comprises at least one antibody or antibody derivative (e.g., a VHH) comprising an antigen recognition domain against Clec4C and one antibody or antibody derivative comprising a recognition domain against an antigen associated with a cell, tissue or organ site affected by an autoimmune disease.

In various embodiments, the present multispecific chimeric proteins or chimeric protein complexes have two or more targeting moieties that target different antigens or receptors, and one targeting moiety may be attenuated for its antigen or receptor, e.g. the targeting moiety binds its antigen or receptor with a low affinity or avidity (including, for example, at an affinity or avidity that is less than the affinity or avidity the other targeting moiety has for its for its antigen or receptor, for instance the difference between the binding affinities may be about 10-fold, or 25-fold, or 50-fold, or 100-fold, or 300-fold, or 500-fold, or 1000-fold, or 5000-fold; for instance the lower affinity or avidity targeting moiety may bind its antigen or receptor at a $K_D$ in the mid- to high-nM or low- to mid-µM range while the higher affinity or avidity targeting moiety may bind its antigen or receptor at a $K_D$ in the mid- to high-pM or low- to mid-nM range). For instance, in some embodiments, the present multispecific chimeric protein or chimeric protein complex comprises an attenuated targeting moiety that is directed against a promiscuous antigen or receptor, which may improve targeting to a cell of interest (e.g. via the other targeting moiety) and prevent effects across multiple types of cells, including those not being targeted for therapy (e.g. by binding promiscuous antigen or receptor at a higher affinity than what is provided in these embodiments).

The multispecific chimeric protein or chimeric protein complex of the invention may be constructed using methods known in the art, see for example, U.S. Pat. No. 9,067,991, U.S. Patent Publication No. 20110262348 and WO 2004/041862, the entire contents of which are hereby incorporated by reference. In an illustrative embodiment, the multispecific chimeric protein or chimeric protein complex of the invention comprising two or more targeting moieties may be constructed by chemical crosslinking, for example, by reacting amino acid residues with an organic derivatizing agent as described by Blattler et al., Biochemistry 24, 1517-1524 and EP294703, the entire contents of which are hereby incorporated by reference. In another illustrative embodiment, the multispecific chimeric protein or chimeric protein complex comprising two or more targeting moieties is constructed by genetic fusion, i.e., constructing a single polypeptide which includes the polypeptides of the individual targeting moieties. For example, a single polypeptide construct may be formed which encodes a first antibody or antibody derivative (e.g., a VHH) with an antigen recognition domain against Clec4C and a second antibody or antibody derivative with a recognition domain against a tumor antigen. A method for producing bivalent or multivalent VHH polypeptide constructs is disclosed in PCT patent application WO 96/34103, the entire contents of which is hereby incorporated by reference. In a further illustrative embodiment, the multispecific chimeric protein or chimeric protein complex of the invention may be constructed by using linkers. For example, the carboxy-terminus of a first antibody or antibody derivative (e.g., a VHH) with an antigen recognition domain against Clec4C may be linked to the amino-terminus of a second antibody or antibody derivative with a recognition domain against a tumor antigen (or vice versa). Illustrative linkers that may be used are described herein. In some embodiments, the components of the multispecific chimeric protein or chimeric protein complex of the invention are directly linked to each other without the use of linkers.

In various embodiments, the multi-specific chimeric protein or chimeric protein complex of the invention recognizes and binds to Clec4C and one or more antigens found on one or more immune cells, which can include, without limitation, megakaryocytes, thrombocytes, erythrocytes, mast cells, basophils, neutrophils, eosinophils, monocytes, macrophages, natural killer cells, T lymphocytes (e.g., cytotoxic T lymphocytes, T helper cells, natural killer T cells), B lymphocytes, plasma cells, dendritic cells, or subsets thereof. In some embodiments, the chimeric protein or chimeric protein complex specifically binds to an antigen of interest and effectively directly or indirectly recruits one of more immune cells.

In various embodiments, the multi-specific chimeric protein or chimeric protein complex of the invention recognizes and binds to Clec4C and one or more antigens found on tumor cells. In these embodiments, the present chimeric protein or chimeric protein complex may directly or indirectly recruit an immune cell (e.g., a macrophage) to a tumor cell or the tumor microenvironment. In such embodiments, the present chimeric protein or chimeric protein complex enhances phagocytosis of tumor cells by dendritic cells.

In various embodiments, the multi-specific chimeric protein or chimeric protein complex of the invention recognizes and binds to Clec4C and one or more antigens found on one or more cells, tissues, and organ sites affected by autoimmune disease. In these embodiments, the present chimeric protein or chimeric protein complex may directly or indirectly recruit an immune cell (e.g., a macrophage) to a cell, tissue, or organ site affected by autoimmune disease. In such embodiments, the chimeric protein or chimeric protein complex specifically binds to an antigen of interest found on one or more cells, tissues, and organ sites affected by autoimmune disease and effectively directly or indirectly recruits one of more immune cells. In some embodiments, the present chimeric proteins or chimeric protein complexes are capable of, or find use in methods involving, shifting the balance of immune cells in favor of immune attack of a tumor. For instance, the present chimeric protein or chimeric protein complex can shift the ratio of immune cells at a site of clinical importance in favor of cells that can kill and/or suppress a tumor (e.g. anti-tumor macrophages (e.g. M1 macrophages), T cells, cytotoxic T lymphocytes, T helper cells, natural killer (NK) cells, natural killer T (NKT) cells, B cells, and dendritic cells) and in opposition to cells that protect tumors (e.g. myeloid-derived suppressor cells (MDSCs), regulatory T cells (Tregs); tumor associated neutrophils (TANs), M2 macrophages, tumor associated macrophages (TAMs), or subsets thereof). In some embodiments, the present chimeric protein or chimeric protein complex is capable of increasing a ratio of effector T cells to regulatory T cells.

In some embodiments, the multi-specific chimeric protein or chimeric protein complex of the invention comprises a targeting moiety having a recognition domain that specifically binds to a target (e.g. antigen or receptor) associated with tumor cells. In some embodiments, the targeting moiety directly or indirectly recruits tumor cells. For instance, in some embodiments, the recruitment of the tumor cell is to one or more effector cell (e.g. a macrophage) that can phagocytose, kill, and/or suppress the tumor cell.

Tumor cells, or cancer cells refer to an uncontrolled growth of cells or tissues and/or an abnormal increased in cell survival and/or inhibition of apoptosis which interferes with the normal functioning of bodily organs and systems. For example, tumor cells include benign and malignant cancers, polyps, hyperplasia, as well as dormant tumors or micrometastases. Illustrative tumor cells include, but are not limited to cells of: basal cell carcinoma, biliary tract cancer; bladder cancer; bone cancer; brain and central nervous system cancer; breast cancer; cancer of the peritoneum; cervical cancer; choriocarcinoma; colon and rectum cancer; connective tissue cancer; cancer of the digestive system; endometrial cancer; esophageal cancer; eye cancer; cancer of the head and neck; gastric cancer (including gastrointestinal cancer); glioblastoma; hepatic carcinoma; hepatoma; intra-epithelial neoplasm; kidney or renal cancer; larynx cancer; leukemia; liver cancer; lung cancer (e.g., small-cell lung cancer, non-small cell lung cancer, adenocarcinoma of the lung, and squamous carcinoma of the lung); melanoma; myeloma; neuroblastoma; oral cavity cancer (lip, tongue, mouth, and pharynx); ovarian cancer; pancreatic cancer; prostate cancer; retinoblastoma; rhabdomyosarcoma; rectal cancer; cancer of the respiratory system; salivary gland carcinoma; sarcoma; skin cancer; squamous cell cancer; stomach cancer; testicular cancer; thyroid cancer; uterine or endometrial cancer; cancer of the urinary system; vulval cancer; lymphoma including Hodgkin's and non-Hodgkin's lymphoma, as well as B-cell lymphoma (including low grade/follicular non-Hodgkin's lymphoma (NHL); small lymphocytic (SL) NHL; intermediate grade/follicular NHL; intermediate grade diffuse NHL; high grade immunoblastic NHL; high grade lymphoblastic NHL; high grade small non-cleaved cell NHL; bulky disease NHL; mantle cell lymphoma; AIDS-related lymphoma; and Waldenstrom's Macroglobulinemia; chronic lymphocytic leukemia (CLL); acute lymphoblastic leukemia (ALL); Hairy cell leukemia; chronic myeloblastic leukemia; as well as other carcinomas and sarcomas; and post-transplant lymphoproliferative disorder (PTLD), as well as abnormal vascular proliferation associated with phakomatoses, edema (e.g. that associated with brain tumors), and Meigs' syndrome.

Tumor cells, or cancer cells also include, but are not limited to, carcinomas, e.g. various subtypes, including, for example, adenocarcinoma, basal cell carcinoma, squamous cell carcinoma, and transitional cell carcinoma), sarcomas (including, for example, bone and soft tissue), leukemias (including, for example, acute myeloid, acute lymphoblastic, chronic myeloid, chronic lymphocytic, and hairy cell), lymphomas and myelomas (including, for example, Hodgkin and non-Hodgkin lymphomas, light chain, non-secretory, MGUS, and plasmacytomas), and central nervous system cancers (including, for example, brain (e.g. gliomas (e.g. astrocytoma, oligodendroglioma, and ependymoma), meningioma, pituitary adenoma, and neuromas, and spinal cord tumors (e.g. meningiomas and neurofibroma).

Illustrative tumor antigens include, but are not limited to, MART-1/Melan-A, gp100, Dipeptidyl peptidase IV (DPPIV), adenosine deaminase-binding protein (ADAbp), cyclophilin b, Colorectal associated antigen (CRC)-0017-1A/GA733, Carcinoembryonic Antigen (CEA) and its immunogenic epitopes CAP-1 and CAP-2, etv6, aml1, Prostate Specific Antigen (PSA) and its immunogenic epitopes PSA-1, PSA-2, and PSA-3, prostate-specific membrane antigen (PSMA), T-cell receptor/CD3-zeta chain, MAGE-family of tumor antigens (e.g., MAGE-A1, MAGE-A2, MAGE- A3, MAGE-A4, MAGE-A5, MAGE-A6, MAGE-A7, MAGE-A8, MAGE-A9, MAGE-A10, MAGE-A11, MAGE-A12, MAGE-Xp2 (MAGE-B2), MAGE-Xp3 (MAGE-B3), MAGE-Xp4 (MAGE-B4), MAGE-C1, MAGE-C2, MAGE-C3, MAGE-C4, MAGE-C5), GAGE-family of tumor antigens (e.g., GAGE-1, GAGE-2, GAGE-3, GAGE-4, GAGE-5, GAGE-6, GAGE-7, GAGE-8, GAGE-9), BAGE, RAGE, LAGE-1, NAG, GnT-V, MUM-1, CDK4, tyrosinase, p53, MUC family, HER2/neu, p21ras, RCAS1, α-fetoprotein, E-cadherin, α-catenin, β-catenin and γ-catenin, p120ctn, gp100 Pmel117, PRAME, NY-ESO-1, cdc27, adenomatous polyposis coli protein (APC), fodrin, Connexin 37, Ig-idiotype, p15, gp75, GM2 and GD2 gangliosides, viral products such as human papilloma virus proteins, Smad family of tumor antigens, Imp-1, NA, EBV-encoded nuclear antigen (EBNA)-1, brain glycogen phosphorylase, SSX-1, SSX-2 (HOM-MEL-40), SSX-1, SSX-4, SSX-5, SCP-1 CT-7, c-erbB-2, CD19, CD20, CD22, CD30, CD33, CD37, CD56, CD70, CD74, CD138, AGS16, MUC1, GPNMB, Ep-CAM, PD-L1, PD-L2, PMSA, and BCMA (TNFRSF17). In various embodiments, the chimeric protein or chimeric protein complex comprises a targeting moiety that binds one or more of these tumor antigens.

In some embodiments, the present multi-specific chimeric protein or chimeric protein complex recognizes and binds to Clec4C as well as an antigen on a tumor cell.

In some embodiments, the multi-specific chimeric protein or chimeric protein complex of the invention comprises a targeting moiety having a recognition domain that specifically binds to a target (e.g. an antigen or receptor) associated with T cells. In some embodiments, the targeting moiety directly or indirectly recruits T cells. In an embodiment, the antigen recognition domains specifically bind to effector T cells. In some embodiments, the antigen recognition domain directly or indirectly recruits effector T cells, e.g., in some embodiments, to a therapeutic site (e.g. a locus with one or more disease cell or cell to be modulated for a therapeutic effect). Illustrative effector T cells include cytotoxic T cells (e.g. αβ TCR, CD3$^+$, CD8$^+$, CD45RO$^+$); CD4$^+$ effector T cells (e.g. αβ TCR, CD3$^+$, CD4$^+$, CCR7$^+$, CD62Lhi, IL-7R/CD127$^+$); CD8$^+$ effector T cells (e.g. αβ TCR, CD3$^+$, CD8$^+$, CCR7$^+$, CD62Lhi, IL-7R/CD127$^+$); effector memory T cells (e.g. CD62Low, CD44$^+$, TCR, CD3$^+$, IL$^-$7R/CD127$^+$, IL-15R$^+$, CCR7low); central memory T cells (e.g. CCR7$^+$, CD62L$^+$, CD27$^+$; or CCR7hi, CD44$^+$, CD62Lhi, TCR, CD3$^+$, IL-7R/CD127$^+$, IL-15R$^+$); CD62L$^+$ effector T cells; CD8$^+$ effector memory T cells (TEM) including early effector memory T cells (CD27$^+$CD62L$^-$) and late effector memory T cells (CD27$^-$CD62L$^-$) (TemE and TemL, respectively); CD127($^+$)CD25(low/−) effector T cells; CD127($^-$) CD25($^-$) effector T cells; CD8$^+$ stem cell memory effector cells (TSCM) (e.g. CD44(low)CD62L(high)CD122(high) sca($^+$)); TH1 effector T-cells (e.g. CXCR3$^+$, CXCR6$^+$ and CCR5$^+$; or αβ TCR, CD3$^+$, CD4$^+$, IL-12R$^+$, IFNγR$^+$, CXCR3$^+$), TH2 effector T cells (e.g. CCR3$^+$, CCR4$^+$ and CCR8$^+$; or αβ TCR, CD3$^+$, CD4$^+$, IL-4R$^+$, IL-33R$^+$, CCR4$^+$, IL-17RB$^+$, CRTH2$^+$); TH9 effector T cells (e.g. αβ TCR, CD3$^+$, CD4$^+$); TH17 effector T cells (e.g. αβ TCR, CD3$^+$, CD4$^+$, IL-23R$^+$, CCR6$^+$, IL-1R$^+$); CD4$^+$CD45RO$^+$ CCR7$^+$ effector T cells, ICOS$^+$ effector T cells; CD4$^+$ CD45RO$^+$CCR7($^-$) effector T cells; and effector T cells secreting IL-2, IL-4 and/or IFN-γ.

Illustrative T cell antigens of interest include, for example (and inclusive of the extracellular domains, where applicable): CD8, CD3, SLAMF4, IL-2Rα, 4-1BB/TNFRSF9, IL-2 R β, ALCAM, B7-1, IL-4 R, B7-H3, BLAME/SLAMF8, CEACAM1, IL-6 R, CCR3, IL-7 Rα, CCR4, CXCRI/IL-S RA, CCR5, CCR6, IL-10R α, CCR7, IL-I 0 R β, CCRS, IL-12 R β 1, CCR9, IL-12 R β 2, CD2, IL-13 R α 1, IL-13, CD3, CD4, ILT2/CD5j, ILT3/CD5k, ILT4/CDS5d, ILT5/CDS5a, lutegrin α 4/CD49d, CDS, Integrin α E/CD103, CD6, Integrin α M/CD 11 b, CDS, Integrin α X/CD11c, Integrin β 2/CDIS, KIR/CD15S, CD27/TNFRSF7, KIR2DL1, CD2S, KIR2DL3, CD30/TNFRSFS, KIR2DL4/CD15Sd, CD31/PECAM-1, KIR2DS4, CD40 Ligand/TNFSF5, LAG-3, CD43, LAIR1, CD45, LAIR2, CDS3, Leukotriene B4-R1, CDS4/SLAMF5, NCAM-L1, CD94, NKG2A, CD97, NKG2C, CD229/SLAMF3, NKG2D, CD2F-10/SLAMF9, NT-4, CD69, NTB-A/SLAMF6, Common γ Chain/IL-2 R γ, Osteopontin, CRACC/SLAMF7, PD-1, CRTAM, PSGL-1, CTLA-4, RANK/TNFRSF11A, CX3CR1, CX3CL1, L-Selectin, CXCR3, SIRP β 1, CXCR4, SLAM, CXCR6, TCCR/WSX-1, DNAM-1, Thymopoietin, EMMPRIN/CD147, TIM-1, EphB6, TIM-2, Fas/TNFRSF6, TIM-3, Fas Ligand/TNFSF6, TIM-4, Fcγ RIII/CD16, TIM-6, TNFR1/TNFRSF1A, Granulysin, TNF RIII/TNFRSF1B, TRAIL RI/TNFRSFIOA, ICAM-1/CD54, TRAIL R2/TNFRSF10B, ICAM-2/CD102, TRAILR3/TNFRSF10C, IFN-γR1, TRAILR4/TNFRSF10D, IFN-γ R2, TSLP, IL-1 R1 and TSLP R. In various embodiments, the chimeric protein or chimeric protein complex comprises a targeting moiety that binds one or more of these illustrative T cell antigens.

By way of non-limiting example, in various embodiments, the present chimeric protein or chimeric protein complex has a targeting moiety directed against a checkpoint marker expressed on a T cell, e.g. one or more of PD-1, CD28, CTLA4, ICOS, BTLA, KIR, LAG3, CD137, OX40, CD27, CD40L, TIM3, and A2aR.

In some embodiments, the multi-specific chimeric protein or chimeric protein complex of the invention comprises a targeting moiety having a recognition domain that specifically binds to a target (e.g. an antigen or receptor) associated with B cells. In some embodiments, the targeting moiety directly or indirectly recruits B cells, e.g., in some embodiments, to a therapeutic site (e.g. a locus with one or more disease cell or cell to be modulated for a therapeutic effect). Illustrative B cell antigens of interest include, for example, CD10, CD19, CD20, CD21, CD22, CD23, CD24, CD37, CD38, CD39, CD40, CD72, CD73, CD74, CDw75, CDw76, CD77, CD78, CD79a/b, CD80, CD81, CD82, CD83, CD84, CD85, CD86, CD89, CD98, CD126, CD127, CDw130, CD138 and CDw150. In various embodiments, the chimeric protein or chimeric protein complex comprises a targeting moiety that binds one or more of these illustrative B cell antigens.

In some embodiments, the multi-specific chimeric protein or chimeric protein complex of the invention comprises a targeting moiety having a recognition domain that specifically binds to a target (e.g. an antigen or receptor) associated with Natural Killer cells. In some embodiments, the targeting moiety directly or indirectly recruits Natural Killer cells, e.g., in some embodiments, to a therapeutic site (e.g. a locus with one or more disease cell or cell to be modulated for a therapeutic effect). Illustrative Natural Killer cell antigens of interest include, for example TIGIT, 2B4/SLAMF4, KIR2DS4, CD155/PVR, KIR3DL1, CD94, LMIR1/CD300A, CD69, LMIR2/CD300c, CRACC/SLAMF7, LMIR3/CD300LF, Kir1alpha, DNAM-1, LMIR5/CD300LB, Fc-epsilon RII, LMIR6/CD300LE, Fc-γ RI/CD64, MICA, Fc-γ RIIB/CD32b, MICB, Fc-γ RIIC/CD32c, MULT-1, Fc-γ RIIA/CD32a, Nectin-2/CD112, Fc-γ RIII/CD16, NKG2A, FcRH1/IRTA5, NKG2C, FcRH2/IRTA4, NKG2D, FcRH4/IRTA1, NKp30, FcRH5/IRTA2, NKp44, Fc-Receptor-like 3/CD16-2, NKp46/NCR1, NKp80/KLRF1, NTB-A/SLAMF6, Rae-1, Rae-1α, Rae-1β, Rae-1 delta, H60, Rae-1 epsilon, ILT2/CD85j, Rae-1 γ, ILT3/CD85k, TREM-1, ILT4/CD85d, TREM-2, ILT5/CD85a, TREM-3, KIR/CD158, TREML1/TLT-1, KIR2DL1, ULBP-1, KIR2DL3, ULBP-2, KIR2DL4/CD158d and ULBP-3. In various embodiments, the chimeric protein or chimeric protein complex comprises a targeting moiety that binds one or more of these illustrative NK cell antigens.

In some embodiments, the multi-specific chimeric protein or chimeric protein complex of the invention comprises a targeting moiety having a recognition domain that specifically binds to a target (e.g. an antigen or receptor) associated with macrophages/monocytes. In some embodiments, the targeting moiety directly or indirectly directly or indirectly recruits macrophages/monocytes, e.g., in some embodiments, to a therapeutic site (e.g. a locus with one or more disease cell or cell to be modulated for a therapeutic effect). Illustrative macrophages/monocyte antigens of interest include, for example SIRP1a, B7-1/CD80, ILT4/CD85d, B7-H1, ILT5/CD85a, Common β Chain, Integrin α 4/CD49d, BLAME/SLAMF8, Integrin α X/CDIIc, CCL6/C10, Integrin β 2/CD18, CD155/PVR, Integrin β3/CD61, CD31/PECAM-1, Latexin, CD36/SR-B3, Leukotriene B4 R1, CD40/TNFRSF5, LIMPIIISR-B2, CD43, LMIR1/CD300A, CD45, LMIR2/CD300c, CD68, LMIR3/CD300LF, CD84/SLAMF5, LMIR5/CD300LB, CD97, LMIR6/CD300LE, CD163, LRP-1, CD2F-10/SLAMF9, MARCO, CRACC/SLAMF7, MD-1, ECF-L, MD-2, EMMPRIN/CD147, MGL2, Endoglin/CD105, Osteoactivin/GPNMB, Fc-γRI/CD64, Osteopontin, Fc-γ RIIB/CD32b, PD-L2, Fc-γ RIIC/CD32c, Siglec-3/CD33, Fc-γ RIIA/CD32a, SIGNR1/CD209, Fc-γ RIII/CD16, SLAM, GM-CSF R α, TCCR/WSX-1, ICAM-2/CD102, TLR3, IFN-γ RI, TLR4, IFN-gannna R2, TREM-I, IL-I RII, TREM-2, ILT2/CD85j, TREM-3, ILT3/CD85k, TREML1/TLT-1, 2B4/SLAMF 4, IL-10 R α, ALCAM, IL-10 R β, Aminopeptidase N/ANPEP, ILT2/CD85j, Common β Chain, ILT3/CD85k, C1q R1/CD93, ILT4/CD85d, CCR1, ILT5/CD85a, CCR2, CD206, Integrin α 4/CD49d, CCR5, Integrin α M/CDII b, CCR8, Integrin α X/CDIIc, CD155/PVR, Integrin β 2/CD18, CD14, Integrin β 3/CD61, CD36/SR-B3, LAIR1, CD43, LAIR2, CD45, Leukotriene B4-R1, CD68, LIMPII-ISR-B2, CD84/SLAMF5, LMIR1/CD300A, CD97, LMIR2/CD300c, CD163, LMIR3/CD300LF, Coagulation Factor III/Tissue Factor, LMIR5/CD300LB, CX3CR1, CX3CL1, LMIR6/CD300LE, CXCR4, LRP-1, CXCR6, M-CSF R, DEP-1/CD148, MD-1, DNAM-1, MD-2, EMMPRIN/CD147, MMR, Endoglin/CD105, NCAM-L1, Fc-γ RI/CD64, PSGL-1, Fc-γ RIIICD16, RP105, G-CSF R, L-Selectin, GM-CSF R α, Siglec-3/CD33, HVEM/TNFRSF14, SLAM, ICAM-1/CD54, TCCR/WSX-1, ICAM-2/CD102, TREM-1, IL-6 R, TREM-2, CXCRI/IL-8 RA, TREM-3 and TREMLI/TLT-1. In various embodiments, the chimeric protein or chimeric protein complex comprises a targeting moiety that binds one or more of these illustrative macrophage/monocyte antigens.

In some embodiments, the multi-specific chimeric protein or chimeric protein complex of the invention comprises a targeting moiety having a recognition domain that specifically binds to a target (e.g. an antigen or receptor) associated with dendritic cells. In some embodiments, the targeting moiety directly or indirectly recruits dendritic cells, e.g., in some embodiments, to a therapeutic site (e.g. a locus with one or more disease cell or cell to be modulated for a therapeutic effect). Illustrative dendritic cell antigens of interest include, for example, Clec4C, Clec9A, XCR1, RANK, CD36/SRB3, LOX-1/SR-E1, CD68, MARCO, CD163, SR-Ai/MSR, CD5L, SREC-1, CL-PI/COLEC12, SREC-II, LIMPIIISRB2, RP105, TLR4, TLR1, TLR5, TLR2, TLR6, TLR3, TLR9, 4-IBB Ligand/TNFSF9, IL-12/IL-23 p40, 4-Amino-1,8-naphthalimide, ILT2/CD85j, CCL21/6Ckine, ILT3/CD85k, 8-oxo-dG, ILT4/CD85d, 8D6A, ILT5/CD85a, A2B5, lutegrin α 4/CD49d, Aag, Integrin β 2/CD18, AMICA, Langerin, B7-2/CD86, Leukotriene B4 RI, B7-H3, LMIR1/CD300A, BLAME/SLAMF8, LMIR2/CD300c, Clq R1/CD93, LMIR3/CD300LF, CCR6, LMIR5/CD300LB CCR7, LMIR6/CD300LE, CD40/TNFRSF5, MAG/Siglec-4-a, CD43, MCAM, CD45, MD-1, CD68, MD-2, CD83, MDL-1/CLEC5A, CD84/SLAMF5, MMR, CD97, NCAMLI, CD2F-10/SLAMF9, Osteoactivin GPNMB, Chern 23, PD-L2, CLEC-1, RP105, CLEC-2, CLEC-8, Siglec-2/CD22, CRACC/SLAMF7, Siglec-3/CD33, DC-SIGN, DCE205, Siglec-5, DC-SIGNR/CD299, Siglec-6, DCAR, Siglec-7, DCIR/CLEC4A, Siglec-9, DEC-205, Siglec-10, Dectin-1/CLEC7A, Siglec-F, Siglec-H, Dectin-2/CLEC6A, SIGNR1/CD209, DEP-1/CD148, SIGNR4, DLEC, SLAM, EMMPRIN/CD147, TCCR/WSX-1, Fc-γ R1/CD64, TLR3, Fc-γ RIIB/CD32b, TREM-1, Fc-γ RIIC/CD32c, TREM-2, Fc-γ RIIA/CD32a, TREM-3, Fc-γ RIII/CD16, TREML1/TLT-1, ICAM-2/CD102 and Vanilloid R1. In various embodiments, the chimeric protein or chimeric protein complex comprises a targeting moiety that binds one or more of these illustrative DC antigens.

In some embodiments, the multi-specific chimeric protein or chimeric protein complex of the invention comprises a targeting moiety having a recognition domain that specifically binds to a target (e.g. an antigen or receptor) associated with immune cells selected from, but not limited to, megakaryocytes, thrombocytes, erythrocytes, mast cells, basophils, neutrophils, eosinophils, or subsets thereof. In some embodiments, the antigen recognition domains directly or indirectly recruit megakaryocytes, thrombocytes, erythrocytes, mast cells, basophils, neutrophils, eosinophils, or subsets thereof, e.g., in some embodiments, to a therapeutic site (e.g. a locus with one or more disease cell or cell to be modulated for a therapeutic effect).

In some embodiments, the multi-specific chimeric protein or chimeric protein complex of the invention comprises a targeting moiety having a recognition domain that specifically binds to a target (e.g. an antigen or receptor) associated with megakaryocytes and/or thrombocytes. Illustrative megakaryocyte and/or thrombocyte antigens of interest include, for example, GP IIb/IIIa, GPIb, vWF, PF4, and TSP. In various embodiments, the chimeric protein or chimeric protein complex comprises a targeting moiety that binds one or more of these illustrative megakaryocyte and/or thrombocyte antigens.

In some embodiments, the multi-specific chimeric protein or chimeric protein complex of the invention comprises a targeting moiety having a recognition domain that specifically binds to a target (e.g. an antigen or receptor) associated with erythrocytes. Illustrative erythrocyte antigens of interest include, for example, CD34, CD36, CD38, CD41a (platelet glycoprotein IIb/IIIa), CD41b (GPIIb), CD71 (transferrin receptor), CD105, glycophorin A, glycophorin C, c-kit, HLA-DR, H2 (MHC-II), and Rhesus antigens. In various embodiments, the chimeric protein or chimeric protein complex comprises a targeting moiety that binds one or more of these illustrative erythrocyte antigens.

In some embodiments, the multi-specific chimeric protein or chimeric protein complex of the invention comprises a targeting moiety having a recognition domain that specifically binds to a target (e.g. an antigen or receptor) associated with mast cells. Illustrative mast cells antigens of interest include, for example, SCFR/CD117, Fc$_\epsilon$RI, CD2, CD25, CD35, CD88, CD203c, C5R1, CMAI, FCERIA, FCER2, TPSABI. In various embodiments, the chimeric protein or chimeric protein complex comprises a targeting moiety that binds one or more of these mast cell antigens.

In some embodiments, the multi-specific chimeric protein or chimeric protein complex of the invention comprises a targeting moiety having a recognition domain that specifically binds to a target (e.g. an antigen or receptor) associated with basophils. Illustrative basophils antigens of interest include, for example, Fc$_\epsilon$RI, CD203c, CD123, CD13, CD107a, CD107b, and CD164. In various embodiments, the chimeric protein or chimeric protein complex comprises a targeting moiety that binds one or more of these basophil antigens.

In some embodiments, the multi-specific chimeric protein or chimeric protein complex of the invention comprises a targeting moiety having a recognition domain that specifically binds to a target (e.g. an antigen or receptor) associated with neutrophils. Illustrative neutrophils antigens of interest include, for example, 7D5, CD10/CALLA, CD13, CD16 (FcRIII), CD18 proteins (LFA-1, CR3, and p150, 95), CD45, CD67, and CD177. In various embodiments, the chimeric protein or chimeric protein complex comprises a targeting moiety that binds one or more of these neutrophil antigens.

In some embodiments, the multi-specific chimeric protein or chimeric protein complex of the invention comprises a targeting moiety having a recognition domain that specifically binds to a target (e.g. an antigen or receptor) associated with eosinophils. Illustrative eosinophils antigens of interest include, for example, CD35, CD44 and CD69. In various embodiments, the chimeric protein or chimeric protein complex comprises a targeting moiety that binds one or more of these eosinophil antigens.

In various embodiments, the multi-specific chimeric protein or chimeric protein complex of the invention comprises a targeting moiety having a recognition domain that specifically binds to an appropriate antigen or cell surface marker known by the skilled artisan. In some embodiments, the antigen or cell surface marker is a tissue-specific marker. Illustrative tissue-specific markers include, but are not limited to, endothelial cell surface markers such as ACE, CD14, CD34, CDH5, ENG, ICAM2, MCAM, NOS3, PECAMI, PROCR, SELE, SELP, TEK, THBD, VCAMI, VWF; smooth muscle cell surface markers such as ACTA2, MYHIO, MYHI 1, MYH9, MYOCD; fibroblast (stromal) cell surface markers such as ALCAM, CD34, COLIAI, COL1A2, COL3A1, FAP, PH-4; epithelial cell surface markers such as CDID, K6IRS2, KRTIO, KRT13, KRT17, KRT18, KRT19, KRT4, KRT5, KRT8, MUCI, TACSTDI; neovasculature markers such as CD13, TFNA, Alpha-v beta-3 ($\alpha$V$\beta$3), E-selectin; and adipocyte surface markers such as ADIPOQ, FABP4, and RETN. In various embodiments, the chimeric protein or chimeric protein complex comprises a targeting moiety that binds one or more of these antigens. In various embodiments, a targeting moiety of the chimeric protein or chimeric protein complex binds one or more of cells having these antigens.

In various embodiments, the multi-specific chimeric protein or chimeric protein complex of the invention has one or more targeting moieties directed against a checkpoint marker, e.g. one or more of PD-1/PD-L1 or PD-L2, CD28/CD80 or CD86, CTLA4/CD80 or CD86, ICOS/ICOSL or B7RP1, BTLA/HVEM, KIR, LAG3, CD137/CD137L, OX40/OX40L, CD27, CD40L, TIM3/Gal9, and A2aR.

By way of non-limiting example, in various embodiments, the present chimeric protein or chimeric protein complex has a targeting moiety directed against (i) a checkpoint marker expressed on a T cell, e.g. one or more of PD-1, CD28, CTLA4, ICOS, BTLA, KIR, LAG3, CD137, OX40, Cd27, CD40L, TIM3, and A2aR and (ii) a targeting moiety is directed against a tumor cell, along with any of the modified (e.g. mutant) signaling agents described herein.

In various embodiments, the present multi-specific chimeric protein or chimeric protein complex has one or more targeting moieties directed against PD-1. In some embodiments, the chimeric protein or chimeric protein complex has one or more targeting moieties which selectively bind a PD-1 polypeptide. In some embodiments, the chimeric protein or chimeric protein complex comprises one or more antibodies, antibody derivatives or formats, peptides or polypeptides, or fusion proteins that selectively bind a PD-1 polypeptide.

In various embodiments, the PD-1 targeting moiety is a protein-based agent capable of specific binding to PD-1. In various embodiments, the PD-1 targeting moiety is a protein-based agent capable of specific binding to PD-1 without functional modulation (e.g., partial or full neutralization) of PD-1.

Programmed cell death protein 1, also known as PD-1 and cluster of differentiation 279 (CD279), is a cell surface receptor that is primarily expressed on activated T cells, B cells, and macrophages. PD-1 has been shown to negatively regulate antigen receptor signaling upon engagement of its ligands (i.e., PD-L1 and/or PD-L2). PD-1 plays an important role in down-regulating the immune system and promoting self tolerance by suppressing T cell inflammatory activity. PD-1 is a type I transmembrane glycoprotein containing an Ig Variable-type (V-type) domain responsible for ligand binding and a cytoplasmic tail that is responsible for the binding of signaling molecules. The cytoplasmic tail of PD-1 contains two tyrosine-based signaling motifs, an ITIM (immunoreceptor tyrosine-based inhibition motif) and an ITSM (immunoreceptor tyrosine-based switch motif).

In various embodiments, the PD-1 targeting moiety comprises an antigen recognition domain that recognizes an epitope present on PD-1. In an embodiment, the antigen-recognition domain recognizes one or more linear epitopes present on PD-1. As used herein, a linear epitope refers to any continuous sequence of amino acids present on PD-1. In another embodiment, the antigen-recognition domain recognizes one or more conformational epitopes present on PD-1. As used herein, a conformation epitope refers to one or more sections of amino acids (which may be discontinuous) which form a three-dimensional surface with features and/or shapes and/or tertiary structures capable of being recognized by an antigen recognition domain.

In various embodiments, the PD-1 targeting moiety binds to the full-length and/or mature forms and/or isoforms and/or splice variants and/or fragments and/or any other naturally occurring or synthetic analogs, variants, or mutants of human PD-1. In various embodiments, the PD-1 targeting moiety binds to any forms of the human PD-1. In an embodiment, the PD-1 targeting moiety binds to a phosphorylated form of PD-1.

In an embodiment, the PD-1 targeting moiety comprises an antigen recognition domain that recognizes one or more epitopes present on human PD-1. In an embodiment, the human PD-1 comprises the amino acid sequence of (signal peptide underlined):

```
                                              (SEQ ID NO: 332)
MQIPQAPWPVVWAVLQLGWRPGWFLDSPDRPWNPPTFSPALLVVTEGDNAT

FTCSFSNTSESFVLNWYRMSPSNQTDKLAAFPEDRSQPGQDCRFRVTQLPN

GRDFHMSVVRARRNDSGTYLCGAISLAPKAQIKESLRAELRVTERRAEVPT

AHPSPSPRPAGQFQTLVVGVVGGLLGSLVLLVWVLAVICSRAARGTIGARR

TGQPLKEDPSAVPVFSVDYGELDFQWREKTPEPPVPCVPEQTEYATIVFPS

GMGTSSPARRGSADGPRSAQPLRPEDGHCSWPL.
```

In another embodiment, the human PD-1 comprises the amino acid sequence of SEQ ID NO: 332 without the amino-terminal signal peptide.

In various embodiments, the PD-1 targeting moiety is capable of specific binding. In various embodiments, the PD-1 targeting moiety comprises an antigen recognition domain such as an antibody or derivatives thereof. In an embodiment, the PD-1 targeting moiety is an antibody. In various embodiments, the antibody is a full-length multimeric protein that includes two heavy chains and two light chains. Each heavy chain includes one variable region (e.g., $V_H$) and at least three constant regions (e.g., $CH_1$, $CH_2$ and $CH_3$), and each light chain includes one variable region ($V_L$) and one constant region ($C_L$). The variable regions determine the specificity of the antibody. Each variable region comprises three hypervariable regions also known as complementarity determining regions (CDRs) flanked by four relatively conserved framework regions (FRs). The three CDRs, referred to as CDR1, CDR2, and CDR3, contribute to the antibody binding specificity. In some embodiments, the antibody is a chimeric antibody. In some embodiments, the antibody is a humanized antibody.

In some embodiments, the PD-1 targeting moiety is an antibody derivative or format. In some embodiments, the PD-1 targeting moiety comprises a single-domain antibody, a recombinant heavy-chain-only antibody (VHH), a single-chain antibody (scFv), a shark heavy-chain-only antibody (VNAR), a microprotein (cysteine knot protein, knottin), a DARPin; a Tetranectin; an Affibody; a Transbody; an Anticalin; an AdNectin; an Affilin; an Affimer, a Microbody; an aptamer; an alterase; a plastic antibody; a phylomer; a stradobody; a maxibody; an evibody; a fynomer, an armadillo repeat protein, a Kunitz domain, an avimer, an atrimer, a probody, an immunobody, a triomab, a troybody; a pepbody; a vaccibody, a UniBody; a DuoBody, a Fv, a Fab, a Fab', a F(ab')$_2$, a peptide mimetic molecule, or a synthetic molecule, as described in U.S. Pat. Nos. or Patent Publication Nos. U.S. Pat. No. 7,417,130, US 2004/132094, U.S. Pat. No. 5,831,012, US 2004/023334, U.S. Pat. Nos. 7,250,297, 6,818,418, US 2004/209243, U.S. Pat. Nos. 7,838,629, 7,186,524, 6,004,746, 5,475,096, US 2004/146938, US 2004/157209, U.S. Pat. Nos. 6,994,982, 6,794,144, US 2010/239633, U.S. Pat. No. 7,803,907, US 2010/119446, and/or U.S. Pat. No. 7,166,697, the contents of which are hereby incorporated by reference in their entireties. See also, Storz MAbs. 2011 May-June; 3(3): 310-317.

In some embodiments, the PD-1 targeting moiety comprises a single-domain antibody, such as a VHH. The VHH may be derived from, for example, an organism that produces VHH antibody such as a camelid, a shark, or the VHH may be a designed VHH. VHHs are antibody-derived therapeutic proteins that contain the unique structural and functional properties of naturally-occurring heavy-chain antibodies. VHH technology is based on fully functional antibodies from camelids that lack light chains. These heavy-chain antibodies contain a single variable domain ($V_H H$) and two constant domains (CH2 and CH3).

In an embodiment, the PD-1 targeting moiety comprises a VHH. In some embodiments, the VHH is a humanized VHH or camelized VHH.

In some embodiments, the VHH comprises a fully human $V_H$ domain, e.g. a HUMABODY (Crescendo Biologics, Cambridge, UK). In some embodiments, fully human $V_H$ domain, e.g. a HUMABODY is monovalent, bivalent, or trivalent. In some embodiments, the fully human $V_H$ domain, e.g. a HUMABODY is mono- or multi-specific such as monospecific, bispecific, or trispecific. Illustrative fully human $V_H$ domains, e.g. a HUMABODIES are described in, for example, WO2016/113555 and WO2016/113557, the entire disclosure of which is incorporated by reference.

In some embodiments, the PD-1 targeting moiety comprises a VHH comprising a single amino acid chain having four "framework regions" or FRs and three "complementary determining regions" or CDRs. As used herein, "framework region" or "FR" refers to a region in the variable domain which is located between the CDRs. As used herein, "complementary determining region" or "CDR" refers to variable regions in VHHs that contains the amino acid sequences capable of specifically binding to antigenic targets.

In various embodiments, the PD-1 targeting moiety comprises a VHH having a variable domain comprising at least one CDR1, CDR2, and/or CDR3 sequences. In various embodiments, the PD-1 targeting moiety comprises a VHH having a variable region comprising at least one FR1, FR2, FR3, and FR4 sequences.

In some embodiments, the CDR1 sequence of the PD-1 targeting moiety is selected from:

```
                                              (SEQ ID NO: 333)
           GFSMDYYAIA;

(SEQ ID NO: 334)
           GFSMDYYAIA;

(SEQ ID NO: 335)
           GFSVDYYAIA;

(SEQ ID NO: 336)
           GFSMDYYAIA;

(SEQ ID NO: 337)
           GGFNRVSYMG;

(SEQ ID NO: 338)
           GGFNRVSYMG;

(SEQ ID NO: 339)
           GIIKSINFMG;

(SEQ ID NO: 340)
           GFILDYYGIG;

(SEQ ID NO: 341)
           GLSLDYDGVG;

(SEQ ID NO: 342)
           GFILDYYGIG;

(SEQ ID NO: 343)
           GRTFSSLGMG;

(SEQ ID NO: 344)
           GRTFSSLGMG;
```

GFAFGSYDMG; (SEQ ID NO: 345)

GFSFGNNDMS; (SEQ ID NO: 346)

IHAMG; (SEQ ID NO: 347)

INAMA; (SEQ ID NO: 348)

SGTMG; (SEQ ID NO: 349)

GSIASIHAM; (SEQ ID NO: 350)

GSIASIHAMG; (SEQ ID NO: 351)

FYGMG; (SEQ ID NO: 352)

GGTFSFYGMG; (SEQ ID NO: 353)

YYAIA; (SEQ ID NO: 354)

VSYMG; (SEQ ID NO: 355)

INFMG; (SEQ ID NO: 356)

SLGMG; (SEQ ID NO: 357)

SYDMG; and (SEQ ID NO: 358)

NNDMS. (SEQ ID NO: 359)

In some embodiments, the CDR2 sequence of the PD-1 targeting moiety is selected from:

CITGSDFMVDT; (SEQ ID NO: 360)

CITGSDFMVDT; (SEQ ID NO: 361)

CITGSDFMVDT; (SEQ ID NO: 362)

CITGSDFMVDT; (SEQ ID NO: 363)

SVTSGGEI; (SEQ ID NO: 364)

SVTSGGEI; (SEQ ID NO: 365)

STTSDGRT; (SEQ ID NO: 366)

CISSSDGST; (SEQ ID NO: 367)

CISSSDGST; (SEQ ID NO: 368)

CISSSDGST; (SEQ ID NO: 369)

AIAWNGAST; (SEQ ID NO: 370)

AIAWNGAST; (SEQ ID NO: 371)

GINSGGRIT; (SEQ ID NO: 372)

AINSGGGST; (SEQ ID NO: 373)

AITWSGGITYYEDSVKG; (SEQ ID NO: 374)

VITWSGGITYYADSVKG; (SEQ ID NO: 375)

VITVSGGITYYADSVKG; (SEQ ID NO: 376)

AITWSGGITYYADSLKG; (SEQ ID NO: 377)

LISWSGGSTYYEDSVKG; (SEQ ID NO: 378)

SIPWSGGRIYYADSVKG; (SEQ ID NO: 379)

VITWSGGITY; (SEQ ID NO: 380)

VITVSGGITY; (SEQ ID NO: 381)

DIRTSAGRTYYADSVKG; (SEQ ID NO: 382)

DIRTSAGRTY; (SEQ ID NO: 383)

CITGSDFMVDTY; (SEQ ID NO: 384)

CITGSDFMVDTYYVASVKG; (SEQ ID NO: 385)

SVTSGGEIT; (SEQ ID NO: 386)

SVTSGGEITIADSVKG; (SEQ ID NO: 387)

SVTSGGEITVADSVKG; (SEQ ID NO: 388)

STTSDGRTT; (SEQ ID NO: 389)

STTSDGRTTVADSVKG; (SEQ ID NO: 390)

CISSSDGSTY; (SEQ ID NO: 391)

AIAWNGASTY; (SEQ ID NO: 392)

AIAWNGASTYYTESVKG; (SEQ ID NO: 393)

GINSGGRITD; (SEQ ID NO: 394)

GINSGGRITDYADSVTG; (SEQ ID NO: 395)

-continued

```
                                  (SEQ ID NO: 396)
AINSGGGSTY;
and (SEQ ID NO: 397)
AINSGGGSTYYADSVKG.
```

In some embodiments, the CDR3 sequence of the PD-1 targeting moiety is selected from:

```
                                  (SEQ ID NO: 398)
AVRSTANTLCPSHYSVMDY;

(SEQ ID NO: 399)
AVRSTANTLCPSHYSVMDY;

(SEQ ID NO: 400)
AVRSTANTLCPSHYSIMDY;

(SEQ ID NO: 401)
AVRSTANTLCPSHYSVMDY;

(SEQ ID NO: 402)
NADIWVSDARMYNY;

(SEQ ID NO: 403)
NADIWVSDARMYNY;

(SEQ ID NO: 404)
NADIWLPSDRMYNY;

(SEQ ID NO: 405)
ATATLCDGGIWGY;

(SEQ ID NO: 406)
ATATLCDGGIWGY;

(SEQ ID NO: 407)
ATATLCDGGIWGY;

(SEQ ID NO: 408)
AASGLGSVVVTANEYDY;

(SEQ ID NO: 409)
AASGLGSVVVTANEYDY;

(SEQ ID NO: 410)
AQGDRSSWHYYGMDY;

(SEQ ID NO: 411)
ATKSDPMTNEYDL;

(SEQ ID NO: 412)
DRAESSWYDY;

(SEQ ID NO: 413)
DKHQSSWYDY;

(SEQ ID NO: 414)
DKHQSSFYDY;

(SEQ ID NO: 415)
DRAQSSWYDY;

(SEQ ID NO: 416)
DRVDSNWYDY;

(SEQ ID NO: 417)
KERSTGWDFAS;
and (SEQ ID NO: 418)
EMSGISGWDY.
```

In various illustrative embodiments, PD-1 targeting moiety comprises an amino acid sequence selected from the following sequences:

2PD23
```
                                  (SEQ ID NO: 419)
QVQLQESGGGLVQPGGSLRLSCAASGFSMDYYAIAWFRQAPGKEREEISC
ITGSDFMVDTYYVASVKGRFTISRDNAENTAYLQMNNLKPEDTGVYFCAV
RSTANTLCPSHYSVMDYWGKGTQVTVSSAAAYPYDVPDYGSHHHHHH;
```
or

2PD26
```
                                  (SEQ ID NO: 420)
QVQLQESGGGLVQAGGSLRLSCAASGFSMDYYAIAWFRQAPGKEREEISC
ITGSDFMVDTYYVASVKGRFTISRDNAENTAYLQMNNLKPEDTGVYFCAV
RSTANTLCPSHYSVMDYWGKGTQVTVSSAAAYPYDVPDYGSHHHHHH;
```
or

2PD90
```
                                  (SEQ ID NO: 421)
QVQLQESGGGLVQPGGSLRLSCSASGFSVDYYAIAWFRQAPGKEREEISC
ITGSDFMVDTYYVASVKGRFTISRDNAKNTAYLQMNSLKPEDTGVYFCAV
RSTANTLCPSHYSIMDYWGKGTQVTVSSAAAYPYDVPDYGSHHHHHH;
```
or

2PD-106
```
                                  (SEQ ID NO: 422)
QVQLQESGGGLVQPGGSLRLSCSASGFSMDYYAIAWFRQAPGKEREEISC
ITGSDFMVDTYYVASVKGRFTISRDNAKNTAHLQMNSLKPEDTGVYFCAV
RSTANTLCPSHYSVMDYWGKGTQVTVSSAAAYPYDVPDYGSHHHHHH;
```
or

2PD-16
```
                                  (SEQ ID NO: 423)
QVQLQESGGGLVQAGGSLRLSCAASGGFNRVSYMGWYRQAPGTKRELVAS
VTSGGEITIADSVKGRFTVSRDNSKNTLYLQMNGLKPEDGATYWCNADIW
VSDARMYNYWGQGTQVTVSSAAAYPYDVPDYGSHHHHHH;
```
or

2PD71
```
                                  (SEQ ID NO: 424)
QVQLQESGGGLVQTGESLRLSCAASGGFNRVSYMGWYRQAPGSKRELVAS
VTSGGEITVADSVKGRFTVSRDNNKNTLYLQMNGLKPEDGATYWCNADIW
VSDARMYNYWGQGTQVTVSSAAAYPYDVPDYGSHHHHHH;
```
or

2PD-152
```
                                  (SEQ ID NO: 425)
QVQLQESGGGLVQTGESLRLSCAASGIIKSINFMGWYRQPPGTKRELVAS
TTSDGRTTVADSVKGRFTISRDNAKNTIYLEMSSLKPEDTATYWCNADIW
LPSDRMYNYWGQGTQVTVSSAAAYPYDVPDYGSHHHHHH;
```
or

2PD-12
```
                                  (SEQ ID NO: 426)
QVQLQESGGGLVQAGGSLRLSCAVSGFILDYYGIGWFRQAPGKEREAVSC
ISSSDGSTYYADSVKGRFTISRDNALNTLYLQMNSLKPEDTAVYHCATAT
LCDGGIWGYWGQGTQVTVSSAAAYPYDVPDYGSHHHHHH;
```
or

3PD55

(SEQ ID NO: 427)
QVQLQESGGGLAQAGGSLRLSCEGSGLSLDYDGVGWFRQAPGKEREAVSC

ISSSDGSTYYADSVKGRFTISRGNALNTLYLQMNSLKPEDTAVYYCATAT

LCDGGIWGYWGQGTQVTVSSAAAYPYDVPDYGSHHHHHH;
or

3PD82

(SEQ ID NO: 428)
QVQLQESGGGSVQPGGSLRLSCAVSGFILDYYGIGWFRQAPGKEREAVSC

ISSSDGSTYYADSVKGRFTISRDNALNTLYLQMNSLKPEDTAVYYCATAT

LCDGGIWGYWGQGTQVTVSSAAAYPYDVPDYGSHHHHHH;
or

2PD8

(SEQ ID NO: 429)
QVQLQESGGGSVQAGDSLRLSCTASGRTFSSLGMGWFRQAPGKEREFVSA

IAWNGASTYYTESVKGRFTISRDDAKNTVYLQMNSLKPTDTAVYFCAASG

LGSVVVTANEYDYWGQGTQVTVSSAAAYPYDVPDYGSHHHHHH;
or

2PD27

(SEQ ID NO: 430)
QVQLQESGGGSVQPGKSLRLSCAASGRTFSSLGMGWFRQAPGKEREFVSA

IAWNGASTYYTESVKGRFTISRDDAKNTVYLQMNSLKPTDTAVYFCAASG

LGSVVVTANEYDYWGQGTQVTVSSAAAYPYDVPDYGSHHHHHH;
or

2PD82

(SEQ ID NO: 431)
QVQLQESGGGLVQPGGSLRLSCTTSGFAFGSYDMGWVRQAPGKGPEWVSG

INSGGRITDYADSVTGRFTISRDNAKNTLYLQMNSLKPEDTAVYYCAQGD

RSSWHYYGMDYWGKGTQVTVSSAAAYPYDVPDYGSHHHHHH;
or

3PD36

(SEQ ID NO: 432)
QVQLQESGGGLVQPGGSLRLSCAASGFSFGNNDMSWVRQAPGKGPEWVSA

INSGGGSTYYADSVKGRFTISRDNAKNTLYLQMNSLKPEDTAVYYCATKS

DPMTNEYDLWGXGTQVTVSSAAAYPYDVPDYGSHHHHHH.

In various illustrative embodiments, PD-1 targeting moiety comprises an amino acid sequence selected from SEQ ID NO: 419 to SEQ ID NO: 432 without the terminal histidine tag sequence (i.e., HHHHHH; SEQ ID NO: 327).

In some embodiments, PD-1 targeting moiety comprises an amino acid sequence selected from SEQ ID Nos: 419 to SEQ ID NO: 432 (provided above) without the HA tag (i.e., YPYDVPDYGS; SEQ ID NO: 328).

In some embodiments, PD-1 targeting moiety comprises an amino acid sequence selected from SEQ ID Nos: 419 to SEQ ID NO: 432 (provided above) without the AAA linker.

In some embodiments, PD-1 targeting moiety comprises an amino acid sequence selected from SEQ ID Nos: 419 to SEQ ID NO: 432 (provided above) without the AAA linker, HA tag, and terminal histidine tag sequence (i.e., AAAYPYDVPDYGSHHHHHH; SEQ ID NO: 329).

In various embodiments, the PD-1 targeting moiety comprises an amino acid sequence described in U.S. Publication No. 2017/0137517, the entire contents of which are incorporated by reference. By way of example, in some embodiments, the PD-1 targeting moiety comprises one of the following sequences in U.S. Publication No. 2017/0137517:

(SEQ ID NO: 433)
EVQLVESGGGLVQAGGSLRLSCAASGSIASIHAMGWFRQAPGKEREFVAVITWSGGITYYADSVKGRFTISRDN

AKNTVYLQMNSLKPEDTAIYYCAGDKHQSSWYDYWGQGTLVTVSS;

(SEQ ID NO: 434)
EVQLVESGGGLVQAGGSLRLSCAASGSIASIHAMGWFRQAPGKEREFVAVITWSGGITYYADSVKGRFTISRDN

AKNTVYLQMNSLKPEDTATYYCAGDKHQSSWYDYWGQGTLVTVSS;

(SEQ ID NO: 435)
EVQLVESGGGLVQAGGSLRLSCAASGSIASIHAMGWFRQAPGKEREFVAVITWSGGITYYADSVKGRFTISRDN

AKNTVYLQMNSLKPEDTATYYCAGDKHQSSWYDYWGQGTLVKVSS;

(SEQ ID NO: 436)
EVQLVESGGGVVQAGGSLRLSCAASGGTFSFYGMGWFRQAPGKEQEFVADIRTSAGRTYYADSVKGRFTISRD

NAKNTVYLQMNSLKPEDTAVYYCAAEMSGISGWDYWGQGTQVQVSS;

(SEQ ID NO: 437)
EVQLVESGGGVVQAGGSLRLSCAASGGTFSFYGMGWFRQAPGKEQEFVADIRTSAGRTYYADSVKGRFTISRD

NAKNTVYLQMNSLKPEDTAVYYCAAEMSGISGWDYWGQGTLVTVKS;

(SEQ ID NO: 438)
EVQLVESGGGVVQAGGSLRLSCAASGGTFSFYGMGWFRQAPGKEQEFVADIRTSAGRTYYADSVKGRFTISRD

NAKNTVYLQMNSLKPEDTAVYYCAAEMSGISGWDYWGQGTLVTVQS;

(SEQ ID NO: 439)
EVQLVESGGGLVQAGGSLRLSCAASGSIASIHAMGWFRQAPGKEQEFVADIRTSAGRTYYADSVKGRFTISRDN

AKNTVYLQMNSLKPEDTALYYCAAEMSGISGWDYWGQGTLVKVSS;

-continued (SEQ ID NO: 440)
EVQLVESGGGLVQAGGSLRLSCAASGGTFSFYGMGWFRQAPGKEQEFVADIRTSAGRTYYADSVKGRFTISRD
NAKNTVYLQMNSLKPEDTALYYCAAEMSGISGWDYWGQGTLVQVSS;

(SEQ ID NO: 441)
EVQLVESGGGLVQAGGSLRLSCAASGGTFSFYGMGWFRQAPGKEQEFVADIRTSAGRTYYADSVKGRFTISRD
NAKNTVYLQMNSLKPEDTALYYCAAEMSGISGWDYWGQGTLVTVKS;

(SEQ ID NO: 442)
EVQLVESGGGVVQAGGSLRLSCAASGGTFSFYGMGWFRQAPGKEQEFVADIRTSAGRTYYADSVKGRFTISRD
NAKNTVYLQMNSLKPEDTALYYCAAEMSGISGWDYWGQGTLVTVQS;

(SEQ ID NO: 443)
EVQLVESGGGVVQAGGSLRLSCAASGGTFSFYGMGWFRQAPGKEQEFVADIRTSAGRTYYADSVKGRFTISRD
NAKNTVYLQMNSLKPEDTALYYCAAEMSGISGWDYWGQGTLVTVSS;

(SEQ ID NO: 444)
EVQLVESGGGVVQAGGSLRLSCAASGGTFSFYGMGWFRQAPGKEQEFVADIRTSAGRTYYADSVKGRFTISRD
NAKNTVYLQMNSLKPEDTALYYCAAEMSGISGWDYWGQGTLVKVSS;

(SEQ ID NO: 445)
EVQLVESGGGVVQAGGSLRLSCAASGGTFSFYGMGWFRQAPGKEQEFVADIRTSAGRTYYADSVKGRFTISRD
NAKNTVYLQMNSLKPEDTALYYCAAEMSGISGWDYWGQGTLVQVSS;

(SEQ ID NO: 446)
EVQLVESGGGVVQAGGSLRLSCAASGGTFSFYGMGWFRQAPGKEQEFVADIRTSAGRTYYADSVKGRFTISRD
NAKNTVYLQMNSLKPEDTALYYCAAEMSGISGWDYWGQGTLVTVKS;

(SEQ ID NO: 447)
EVQLVESGGGVVQPGGSLRLSCAASGGTFSFYGMGWFRQAPGKEQEFVADIRTSAGRTYYADSVKGRFTISRD
NSKNTVYLQMNSLRPEDTALYYCAAEMSGISGWDYWGQGTLVTVQS;

(SEQ ID NO: 448)
EVQLVESGGGVVQPGGSLRLSCAASGGTFSFYGMGWFRQAPGKEREFVADIRTSAGRTYYADSVKGRFTISRD
NSKNTVYLQMNSLRPEDTALYYCAAEMSGISGWDYWGQGTLVTVSS;

(SEQ ID NO: 449)
DVQLVESGGGVVQPGGSLRLSCAASGGTFSFYGMGWFRQAPGKEQEFVADIRTSAGRTYYADSVKGRFTISRD
NSKNTVYLQMNSLRPEDTALYYCAAEMSGISGWDYWGQGTLVTVSS;

(SEQ ID NO: 450)
DVQLVESGGGVVQPGGSLRLSCAASGGTFSFYGMGWFRQAPGKEREFVADIRTSAGRTYYADSVKGRFTISRD
NSKNTVYLQMNSLRPEDTALYYCAAEMSGISGWDYWGQGTLVTSSA;

(SEQ ID NO: 451)
EVQLVESGGGLVQAGGSLRLSCAASGGTFSFYGMGWFRQAPGKEQEFVADIRTSAGRTYYADSVKGRFTISRD
NAKNTVYLQMNSLKPEDTATYYCAAEMSGISGWDYWGQGTLVKVSSA;

(SEQ ID NO: 452)
EVQLVESGGGVVQAGGSLRLSCAASGGTFSFYGMGWFRQAPGKEQEFVADIRTSAGRTYYADSVKGRFTISRD
NAKNTVYLQMNSLKPEDTAVYYCAAEMSGISGWDYWGQGTLVQVSSA;

(SEQ ID NO: 453)
EVQLVESGGGVVQAGGSLRLSCAASGGTFSFYGMGWFRQAPGKEQEFVADIRTSAGRTYYADSVKGRFTISRD
NAKNTVYLQMNSLKPEDTAVYYCAAEMSGISGWDYWGQGTLVTVKSA;

(SEQ ID NO:454)
EVQLVESGGGVVQAGGSLRLSCAASGGTFSFYGMGWFRQAPGKEQEFVADIRTSAGRTYYADSVKGRFTISRD
NAKNTVYLQMNSLKPEDTAVYYCAAEMSGISGWDYWGQGTLVTVQSA;

(SEQ ID NO: 455)
EVQLVESGGGVVQAGGSLRLSCAASGGTFSFYGMGWFRQAPGKEQEFVADIRTSAGRTYYADSVKGRFTISRD
NAKNTVYLQMNSLKPEDTAVYYCAAEMSGISGWDYWGQGTLVKVSSA;

-continued (SEQ ID NO: 456)
EVQLVESGGGLVQAGGSLRLSCAASGGTFSFYGMGWFRQAPGKEQEFVADIRTSAGRTYYADSVKGRFTISRD
NAKNTVYLQMNSLKPEDTALYYCAAEMSGISGWDYWGQGTLVQVSSA;

(SEQ ID NO: 457)
EVQLVESGGGLVQAGGSLRLSCAASGGTFSFYGMGWFRQAPGKEQEFVADIRTSAGRTYYADSVKGRFTISRD
NAKNTVYLQMNSLKPEDTALYYCAAEMSGISGWDYWGQGTLVTVKSA;

(SEQ ID NO: 458)
EVQLVESGGGLVQAGGSLRLSCAASGGTFSFYGMGWFRQAPGKEQEFVADIRTSAGRTYYADSVKGRFTISRD
NAKNTVYLQMNSLKPEDTALYYCAAEMSGISGWDYWGQGTLVTVQSA;

(SEQ ID NO: 459)
EVQLVESGGGLVQAGGSLRLSCAASGGTFSFYGMGWFRQAPGKEQEFVADIRTSAGRTYYADSVKGRFTISRD
NAKNTVYLQMNSLKPEDTALYYCAAEMSGISGWDYWGQGTLVTVSSA;

(SEQ ID NO: 460)
EVQLVESGGGVVQAGGSLRLSCAASGGTFSFYGMGWFRQAPGKEQEFVADIRTSAGRTYYADSVKGRFTISRD
NAKNTVYLQMNSLKPEDTALYYCAAEMSGISGWDYWGQGTLVKVSSA;

(SEQ ID NO: 461)
EVQLVESGGGVVQAGGSLRLSCAASGGTFSFYGMGWFRQAPGKEQEFVADIRTSAGRTYYADSVKGRFTISRD
NAKNTVYLQMNSLKPEDTALYYCAAEMSGISGWDYWGQGTLVQVSSA;

(SEQ ID NO: 462)
EVQLVESGGGVVQAGGSLRLSCAASGGTFSFYGMGWFRQAPGKEQEFVADIRTSAGRTYYADSVKGRFTISRD
NAKNTVYLQMNSLKPEDTALYYCAAEMSGISGWDYWGQGTLVTVKSA;

(SEQ ID NO: 463)
EVQLVESGGGVVQAGGSLRLSCAASGGTFSFYGMGWFRQAPGKEQEFVADIRTSAGRTYYADSVKGRFTISRD
NAKNTVYLQMNSLKPEDTALYYCAAEMSGISGWDYWGQGTLVTVQSA;

(SEQ ID NO: 464)
EVQLVESGGGVVQAGGSLRLSCAASGGTFSFYGMGWFRQAPGKEQEFVADIRTSAGRTYYADSVKGRFTISRD
NAKNTVYLQMNSLKPEDTALYYCAAEMSGISGWDYWGQGTLVTVSSA;

(SEQ ID NO: 465)
EVQLVESGGGVVQPGGSLRLSCAASGGTFSFYGMGWFRQAPGKEQEFVADIRTSAGRTYYADSVKGRFTISRD
NSKNTVYLQMNSLRPEDTALYYCAAEMSGISGWDYWGQGTLVTVSSA;

(SEQ ID NO: 466)
DVQLVESGGGVVQPGGSLRLSCAASGSIASIHAMGWFRQAPGKEREFVAVITWSGGITYYADSVKGRFTISRDN
SKNTVYLQMNSLRPEDTALYYCAGDKHQSSWYDYWGQGTLVTVSS;

(SEQ ID NO: 467)
EVQLVESGGGLVQPGGSLRLSCAASGSIASIHAMGWERQAPGKEREEVAVITWSGGITYYADSVKGRFTISRDN
SKNTVYLQMNSLRPEDTAIYYCAGDKHQSSWYDYWGQGTLVTVSS;

(SEQ ID NO: 468)
EVQLVESGGGVVQPGGSLRLSCAASGSIASIHAMGWERQAPGKEREEVAVITWSGGITYYADSVKGRFTISRDN
SKNTVYLQMNSLRPEDTALYYCAGDKHQSSWYDYWGQGTLVTVSS;

(SEQ ID NO: 469)
DVQLVESGGGVVQPGGSLRLSCAASGSIASIHAMGWERQAPGKEREEVAVITWSGGITYYADSVKGRFTISRDN
SKNTVYLQMNSLRPEDTALYYCAGDKHQSSWYDYWGQGTLVTVSSGGGGSGGGGSGGGGSGGGGSGGGG
SGGGGSGGGGSEVQLVESGGGVVQPGNSLRLSCAASGFTFSSFGMSWVRQAPGKGLEWVSSISGSGSDTLY
ADSVKGRFTISRDNAKTTLYLQMNSLRPEDTALYYCTIGGSLSRSSQGTLVTVSSA;

-continued (SEQ ID NO: 470)
DVQLVESGGGVVQPGGSLRLSCAASGSIASIHAMGWERQAPGKEREEVAVITWSGGITYYADSVKGRFTISRDN

SKNTVYLQMNSLRPEDTALYYCAGDKHQSSWYDYWGQGTLVTVSSGGGGSGGGGSGGGGSGGGGSGGGG

SGGGGSGGGGSEVQLVESGGGVVQPGGSLRLSCAASGSIASIHAMGWFRQAPGKEREFVAVITWSGGITYYAD

SVKGRFTISRDNSKNTVYLQMNSLRPEDTALYYCAGDKHQSSWYDYWGQGTLVTVSSGGGGSGGGGSGGGG

SGGGGSGGGGSGGGGSGGGGSEVQLVESGGGVVQPGNSLRLSCAASGFTFSSFGMSWVRQAPGKGLESWVS

SISGSGSDTLYADSVKGRFTISRDNAKTTLYLQMNSLRPEDTALYYCTIGGSLSRSSQGTLVTVSSA;

(SEQ ID NO: 471)
DVQLVESGGGVVQPGGSLRLSCAASGSIASIHAMGWERQAPGKEREEVAVITVSGGITYYADSVKGRFTISRDN

SKNTVYLQMNSLRPEDTALYYCAGDKHQSSFYDYWGQGTLVTVSS;

(SEQ ID NO: 472)
DVQLVESGGGVVQPGGSLRLSCAASGSIASIHAMGWFRQAPGKEREFVAVITVSGGITYYADSVKGRFTISRDQ

SKNTVYLQMNSLRPEDTALYYCAGDKHQSSFYDYWGQGTLVTVSS;

(SEQ ID NO: 473)
DVQLVESGGGVVQPGGSLRLSCAASGSIASIHAMGWFRQAPGKEREFVAVITVSGGITYYADSVKGRFTISRDPS

KNTVYLQMNSLRPEDTALYYCAGDKHQSSFYDYWGQGTLVTVSS;

(SEQ ID NO: 474)
DVQLVESGGGVVQPGGSLRLSCAASGSIASIHAMGWFRQAPGKEREFVAVITVSGGITYYADSVKGRFTISRDPS

KNTVYLQMNSLRPEDTALYYCAGDKHQSSFYDYWGQGTLVTVSS;

(SEQ ID NO: 475)
DVQLVESGGGVVQPGGSLRLSCAASGSIASIHAMGWFRQAPGKEREFVAVITVSGGITYYADSVKGRFTISRDQ

SKNTVYLQMNSLRPEDTALYYCAGDKHQSSFYDYWGQGTLVTVSS;

(SEQ ID NO: 476)
DVQLVESGGGVVQPGGSLRLSCAASGSIASIHAMGWFRQAPGKEREFVAVITVSGGITYYADSVKGRFTISRDSS

KNTVYLQMNSLRPEDTALYYCAGDKHQSSFYDYWGQGTLVTVSS;

(SEQ ID NO: 477)
EVQLVESGGGLVQPGGSLRLSCAASGSIASIHAMGWERQAPGKEREEVAVITWSGGITYYADSVKGRFTISRDN

SKNTVYLQMNSLRPEDTAIYYCAGDKHQSSWYDYWGQGTLVTVSSGGGGSGGGGSGGGGSGGGGSGGGGS

GGGGSGGGGSEVQLVESGGGLVQPGGSLRLSCAASGSIASIHAMGWERQAPGKEREEVAVITWSGGITYYADS

VKGRFTISRDNSKNTVYLQMNSLRPEDTAIYYCAGDKHQSSWYDYWGQGTLVTVSSGGGGSGGGGSGGGGS

GGGGSGGGGSGGGGSGGGGSEVQLVESGGGLVQPGNSLRLSCAASGFTFSSFGMSWVRQAPGKGLESWVSS

ISGSGSDTLYADSVKGRFTISRDNAKTTLYLQMNSLRPEDTAVYYCTIGGSLSRSSQGTLVTVSS;
and (SEQ ID NO: 478)
MQIPQAPWPWWAVLQLGWRPGWFLDSPDRPWNPPTFSPALLVVTEGDNATFTCSFSNTSESFVLNWYRMSP

SNQTDKLAAFPEDRSQPGQDCRFRVTQLPNGRDFHMSVVRARRNDSGTYLCGAISLAPKAQIKESLRAELRVTE

RRAEVPTAHPSPSPRPAGQFQTLVVGVVGGLLGSLVLLVWVLAVICSRAARGTIGARRTGQPLKEDPSAVPVFV

DYGELDFQWREKTPEPPVPCVPEQTEYATIVFPSGMGTSSPARRGSADGPRSAQPLRPEDGHCSWPL.

In some embodiments, PD-1 targeting moiety comprises an amino acid sequence selected from SEQ ID NOs: 433-478 having one or more substitutions at positions 1, 11, 14, 52a, 73, 74, 83, 89, 100a, 110, and 112 (according to Kabat numbering). In some embodiments, the amino acid at position 1 is E or D. In some embodiments, the amino acid at position 11 is L or V. In some embodiments, the amino acid at position 14 is A or P. In some embodiments, the amino acid at position 52a is W or V. In some embodiments, the amino acid at position 73 is N, S, P, or Q. In some embodiments, the amino acid at position 74 is A or S. In some embodiments, the amino acid at position 83 is K or R. In some embodiments, the amino acid at position 89 is T, V, I, or L. In some embodiments, the amino acid at position 100a is W or F. In some embodiments, the amino acid at position 110 is T, K, or Q. In some embodiments, the amino acid at position 112 is S, K, or Q.

In various embodiments, PD-1 targeting moiety comprises an amino acid sequence described in PCT Publication No. WO 2017/087587, the entire contents of which are incorporated by reference. By way of example, in some embodiments, PD-1 targeting moiety comprises one of the following sequences in PCT Publication No. WO 2017/087587:

```
                                                            (SEQ ID NO: 479)
EVQLVESGGGLVQAGGSLRLSCAASGGTFSFYGMGWFRQAPGKEQEFVADIRTSAGRTYYADSVKGRFTISRD
NAKNTVYLQMNSLKPEDTAVYYCAAEMSGISGWDYWGQGTQVTVSS;
                                                            (SEQ ID NO: 480)
EVQLVESGGGLVQAGGSLRLSCAASGSIASIHAMGWFRQAPGKEREFVAVITWSGGITYYADSVKGRFTISRDN
AKNTVYLQMNSLKPEDTATYYCAGDKHQSSWYDYWGQGTLVTVSS;
                                                            (SEQ ID NO: 481)
VEVQLVESGGGVVQAGGSLRLSCAASGSIASIHAMGWFRQAPGKEREFVAVITWSGGITYYADSVKGRFTISRDN
AKNTVYLQMNSLKPEDTAIYYCAGDKHQSSWYDYWGQGTLVKVSS;
                                                            (SEQ ID NO: 482)
EVQLVESGGGVVQAGGSLRLSCAASGSIASIHAMGWFRQAPGKEREFVAVITWSGGITYYADSVKGRFTISRDN
AKNTVYLQMNSLKPEDTAIYYCAGDKHQSSWYDYWGQGTLVQVSS;
                                                            (SEQ ID NO: 483)
EVQLVESGGGVVQAGGSLRLSCAASGSIASIHAMGWFRQAPGKEREFVAVITWSGGITYYADSVKGRFTISRDN
AKNTVYLQMNSLKPEDTAIYYCAGDKHQSSWYDYWGQGTLVTVKS;
                                                            (SEQ ID NO: 484)
EVQLVESGGGVVQAGGSLRLSCAASGSIASIHAMGWFRQAPGKEREFVAVITWSGGITYYADSVKGRFTISRDN
AKNTVYLQMNSLKPEDTAIYYCAGDKHQSSWYDYWGQGTLVTVQS;
                                                            (SEQ ID NO: 485)
EVQLVESGGGLVQAGGSLRLSCAASGSIASIHAMGWFRQAPGKEREFVAVITWSGGITYYADSVKGRFTISRDN
AKNTVYLQMNSLKPEDTALYYCAGDKHQSSWYDYWGQGTLVKVSS;
                                                            (SEQ ID NO: 486)
EVQLVESGGGLVQAGGSLRLSCAASGSIASIHAMGWFRQAPGKEREFVAVITWSGGITYYADSVKGRFTISRDN
AKNTVYLQMNSLKPEDTALYYCAGDKHQSSWYDYWGQGTLVQVSS;
                                                            (SEQ ID NO: 487)
EVQLVESGGGLVQAGGSLRLSCAASGSIASIHAMGWFRQAPGKEREFVAVITWSGGITYYADSVKGRFTISRDN
AKNTVYLQMNSLKPEDTALYYCAGDKHQSSWYDYWGQGTLVTVKS;
                                                            (SEQ ID NO: 488)
EVQLVESGGGLVQAGGSLRLSCAASGSIASIHAMGWFRQAPGKEREFVAVITWSGGITYYADSVKGRFTISRDN
AKNTVYLQMNSLKPEDTALYYCAGDKHQSSWYDYWGQGTLVTVQS;
                                                            (SEQ ID NO: 489)
EVQLVESGGGVVQAGGSLRLSCAASGSIASIHAMGWFRQAPGKEREFVAVITWSGGITYYADSVKGRFTISRDN
AKNTVYLQMNSLKPEDTALYYCAGDKHQSSWYDYWGQGTLVTVSS;
                                                            (SEQ ID NO: 490)
EVQLVESGGGVVQAGGSLRLSCAASGSIASIHAMGWFRQAPGKEREFVAVITWSGGITYYADSVKGRFTISRDN
AKNTVYLQMNSLKPEDTALYYCAGDKHQSSWYDYWGQGTLVKVSS;
                                                            (SEQ ID NO: 491)
EVQLVESGGGVVQAGGSLRLSCAASGSIASIHAMGWFRQAPGKEREFVAVITWSGGITYYADSVKGRFTISRDN
AKNTVYLQMNSLKPEDTALYYCAGDKHQSSWYDYWGQGTLVQVSS;
                                                            (SEQ ID NO: 492)
EVQLVESGGGVVQAGGSLRLSCAASGSIASIHAMGWFRQAPGKEREFVAVITWSGGITYYADSVKGRFTISRDN
AKNTVYLQMNSLKPEDTALYYCAGDKHQSSWYDYWGQGTLVTVKS;
                                                            (SEQ ID NO: 493)
EVQLVESGGGVVQAGGSLRLSCAASGSIASIHAMGWFRQAPGKEREFVAVITWSGGITYYADSVKGRFTISRDN
AKNTVYLQMNSLKPEDTALYYCAGDKHQSSWYDYWGQGTLVTVQS;
                                                            (SEQ ID NO: 494)
EVQLVESGGGVVQPGGSLRLSCAASGSIASIHAMGWFRQAPGKEREFVAVITWSGGITYYADSVKGRFTISRDN
SKNTVYLQMNSLRPEDTALYYCAGDKHQSSWYDYWGQGTLVTVSS;
```

```
                                                                    (SEQ ID NO: 495)
DVQLVESGGGVVQPGGSLRLSCAASGSIASIHAMGWFRQAPGKEREFVAVITWSGGITYYADSVKGRFTISRDN
SKNTVYLQMNSLRPEDTALYYCAGDKHQSSWYDYWGQGTLVTVSS;

(SEQ ID NO: 496)
EVQLVESGGGLVQAGGSLRLSCAASGSIASIHAMGWFRQAPGKEREFVAVITWSGGITYYADSVKGRFTISRDN
AKNTVYLQMNSLKPEDTATYYCAGDKHQSSWYDYWGQGTLVTVSSA;

(SEQ ID NO: 497)
EVQLVESGGGVVQAGGSLRLSCAASGSIASIHAMGWFRQAPGKEREFVAVITWSGGITYYADSVKGRFTISRDN
AKNTVYLQMNSLKPEDTAIYYCAGDKHQSSWYDYWGQGTLVKVSSA;

(SEQ ID NO: 498)
EVQLVESGGGVVQAGGSLRLSCAASGSIASIHAMGWFRQAPGKEREFVAVITWSGGITYYADSVKGRFTISRDN
AKNTVYLQMNSLKPEDTAIYYCAGDKHQSSWYDYWGQGTLVQVSSA;

(SEQ ID NO: 499)
EVQLVESGGGVVQAGGSLRLSCAASGSIASIHAMGWFRQAPGKEREFVAVITWSGGITYYADSVKGRFTISRDN
AKNTVYLQMNSLKPEDTAIYYCAGDKHQSSWYDYWGQGTLVTVKSA;

(SEQ ID NO: 500)
EVQLVESGGGVVQAGGSLRLSCAASGSIASIHAtvCWFRQAPGKEREFVAVITWSGGITYYADSVKGRFTISRDN
AKNTVYLQMNSLKPEDTAIYYCAGDKHQSSWYDYWGQGTLVTVQSA;

(SEQ ID NO: 501)
EVQLVESGGGLVQAGGSLRLSCAASGSIASIHAtvCWFRQAPGKEREFVAVITWSGGITYYADSVKGRFTISRDNA
KNTVYLQMNSLKPEDTALYYCAGDKHQSSWYDYWGQGTLVKVSSA;

(SEQ ID NO: 502)
EVQLVESGGGLVQAGGSLRLSCAASGSIASIHAMGWFRQAPGKEREFVAVITWSGGITYYADSVKGRFTISRDN
AKNTVYLQMNSLKPEDTALYYCAGDKHQSSWYDYWGQGTLVQVSSA;

(SEQ ID NO: 503)
EVQLVESGGGLVQAGGSLRLSCAASGSIASIHAMGWFRQAPGKEREFVAVITWSGGITYYADSVKGRFTISRDN
AKNTVYLQMNSLKPEDTALYYCAGDKHQSSWYDYWGQGTLVTVKSA;

(SEQ ID NO: 504)
EVQLVESGGGLVQAGGSLRLSCAASGSIASIHAMGWFRQAPGKEREFVAVITWSGGITYYADSVKGRFTISRDN
AKNTVYLQMNSLKPEDTALYYCAGDKHQSSWYDYWGQGTLVTVQSA;

(SEQ ID NO: 505)
EVQLVESGGGVVQAGGSLRLSCAASGSIASIHAMGWFRQAPGKEREFVAVITWSGGITYYADSVKGRFTISRDN
AKNTVYLQMNSLKPEDTALYYCAGDKHQSSWYDYWGQGTLVTVSSA;

(SEQ ID NO: 506)
EVQLVESGGGVVQAGGSLRLSCAASGSIASIHAMGWFRQAPGKEREFVAVITWSGGITYYADSVKGRFTISRDN
AKNTVYLQMNSLKPEDTALYYCAGDKHQSSWYDYWGQGTLVKVSSA;

(SEQ ID NO: 507)
EVQLVESGGGVVQAGGSLRLSCAASGSIASIHAMGWFRQAPGKEREFVAVITWSGGITYYADSVKGRFTISRDN
AKNTVYLQMNSLKPEDTALYYCAGDKHQSSWYDYWGQGTLVQVSSA;

(SEQ ID NO: 508)
EVQLVESGGGVVQAGGSLRLSCAASGSIASIHAMGWFRQAPGKEREFVAVITWSGGITYYADSVKGRFTISRDN
AKNTVYLQMNSLKPEDTALYYCAGDKHQSSWYDYWGQGTLVTVKSA;

(SEQ ID NO: 509)
EVQLVESGGGVVQAGGSLRLSCAASGSIASIHAMGWFRQAPGKEREFVAVITWSGGITYYADSVKGRFTISRDN
AKNTVYLQMNSLKPEDTALYYCAGDKHQSSWYDYWGQGTLVTVQSA;

(SEQ ID NO: 510)
EVQLVESGGGVVQPGGSLRLSCAASGSIASIHAMGWFRQAPGKEREFVAVITWSGGITYYADSVKGRFTISRDN
SKNTVYLQMNSLRPEDTALYYCAGDKHQSSWYDYWGQGTLVTVSSA;
```

-continued (SEQ ID NO: 511)
DVQLVESGGGVVQPGGSLRLSCAASGSIASIHAMGWFRQAPGKEREFVAVITWSGGITYYADSVKGRFTISRDN
SKNTVYLQMNSLRPEDTALYYCAGDKHQSSWYDYWGQGTLVTVSSA;

(SEQ ID NO: 512)
DVQLVESGGGVVQPGGSLRLSCAASGSIASIHAMGWFRQAPGKEREFVAIITWSGGITYYADSVKGRFTISRDNS
KNTVYLQMNSLRPEDTALYYCAGDKHQSSWYDYWGQGTLVTVSS;

(SEQ ID NO: 513)
EVQLVESGGGLVQPGGSLRLSCAASGSIASIHAMGWFRQAPGKEREFVAVITWSGGITYYADSVKGRFTISRDN
SKNTVYLQMNSLRPEDTAIYYCAGDKHQSSWYDYWGQGTLVTVSS;

(SEQ ID NO: 514)
EVQLVESGGGVVQPGGSLRLSCAASGSIASIHAMGWFRQAPGKEREFVAVITWSGGITYYADSVKGRFTISRDN
SKNTVYLQMNSLRPEDTALYYCAGDKHQSSWYDYWGQGTLVTVSS;

(SEQ ID NO: 515)
DVQLVESGGGVVQPGGSLRLSCAASGSIASIHAMGWFRQAPGKEREFVAVITWSGGITYYADSVKGRFTISRDN
SKNTVYLQMNSLRPEDTALYYCAGDKHQSSWYDYWGQGTLVTVSSGGGGSGGGGSGGGGSGGGGSGGGG
SGGGGSGGGGSEVQLVESGGGVVQPGNSLRLSCAASGFTFSSFGMSWVRQAPGKGLEWVSSISGSGSDTLY
ADSVKGRFTISRDNAKTTLYLQMNSLRPEDTALYYCTIGGSLSRSSQGTLVTVSSA;

(SEQ ID NO: 516)
DVQLVESGGGVVQPGGSLRLSCAASGSIASIHAMGWFRQAPGKEREFVAVITWSGGITYYADSVKGRFTISRDN
SKNTVYLQMNSLRPEDTALYYCAGDKHQSSWYDYWGQGTLVTVSSGGGGSGGGGSGGGGSGGGGSGGGG
SGGGGSGGGGSEVQLVESGGGVVQPGGSLRLSCAASGSIASIHAMGWFRQAPGKEREFVAVITWSGGITYYAD
SVKGRFTISRDNSKNTVYLQMNSLRPEDTALYYCAGDKHQSSWYDYWGQGTLVTVSSGGGGSGGGGSGGGG
SGGGGSGGGGSGGGGSGGGGSEVQLVESGGGVVQPGNSLRLSCAASGFTFSSFGMSWVRQAPGKGLESWVS
SISGSGSDTLYADSVKGRFTISRDNAKTTLYLQMNSLRPEDTALYYCTIGGSLSRSSQGTLVTVSSA;

(SEQ ID NO: 517)
DVQLVESGGGVVQPGGSLRLSCAASGSIASIHAMGWFRQAPGKEREFVAVITVSGGITYYADSVKGRFTISRDNS
KNTVYLQMNSLRPEDTALYYCAGDKHQSSFYDYWGQGTLVTVSS;

(SEQ ID NO: 518)
DVQLVESGGGVVQPGGSLRLSCAASGSIASIHAMGWFRQAPGKEREFVAVITVSGGITYYADSVKGRFTISRDQ
SKNTVYLQMNSLRPEDTALYYCAGDKHQSSFYDYWGQGTLVTVSS;
and (SEQ ID NO: 519)
DVQLVESGGGVVQPGGSLRLSCAASGSIASIHAMGWFRQAPGKEREFVAVITVSGGITYYADSVKGRFTISRDPS
KNTVYLQMNSLRPEDTALYYCAGDKHQSSFYDYWGQGTLVTVSS.

In some embodiments, PD-1 targeting moiety comprises an amino acid sequence selected from SEQ ID NOs: 479-519 having one or more substitutions at positions 1, 11, 14, 52a, 73, 74, 83, 89, 100a, 110, and 112 (according to Kabat numbering). In some embodiments, the amino acid at position 1 is E or D. In some embodiments, the amino acid at position 11 is L or V. In some embodiments, the amino acid at position 14 is A or P. In some embodiments, the amino acid at position 52a is W or V. In some embodiments, the amino acid at position 73 is N, S, P, or Q. In some embodiments, the amino acid at position 74 is A or S. In some embodiments, the amino acid at position 83 is K or R. In some embodiments, the amino acid at position 89 is T, V, I, or L. In some embodiments, the amino acid at position 100a is W or F. In some embodiments, the amino acid at position 110 is T, K, or Q. In some embodiments, the amino acid at position 112 is S, K, or Q.

In various embodiments, the present invention contemplates the use of any natural or synthetic analogs, mutants, variants, alleles, homologs and orthologs (herein collectively referred to as "analogs") of the PD-1 targeting moiety as described herein. In various embodiments, the amino acid sequence of PD-1 targeting moiety further includes an amino acid analog, an amino acid derivative, or other non-classical amino acids.

In an embodiment, the PD-1 targeting moiety comprises the anti-PD-1 antibody pembrolizumab (aka MK-3475, KEYTRUDA), or fragments thereof. Pembrolizumab and other humanized anti-PD-1 antibodies are disclosed in Hamid, et al. (2013) New England Journal of Medicine 369 (2): 134-44, U.S. Pat. No. 8,354,509, and WO 2009/114335, the entire disclosures of which are hereby incorporated by reference. In illustrative embodiments, pembrolizumab or an antigen-binding fragment thereof for use in the methods provided herein comprises a heavy chain comprising the amino acid sequence of SEQ ID NO: 69; and/or a light chain comprising the amino acid sequence of SEQ ID NO: 70).

In an embodiment, the PD-1 targeting moiety comprises the anti-PD-1 antibody, nivolumab (aka BMS-936558, MDX-1106, ONO-4538, OPDIVO), or fragments thereof. Nivolumab (clone 5C4) and other human monoclonal antibodies that specifically bind to PD-1 are disclosed in U.S. US 2011/0318373 or 8,907,053. For example, the targeting moiety may comprise AUNP 12 (i.e., Compound 8 or SEQ ID NO:49 of US 2011/0318373) which has the sequence of (SEQ ID NO:84)

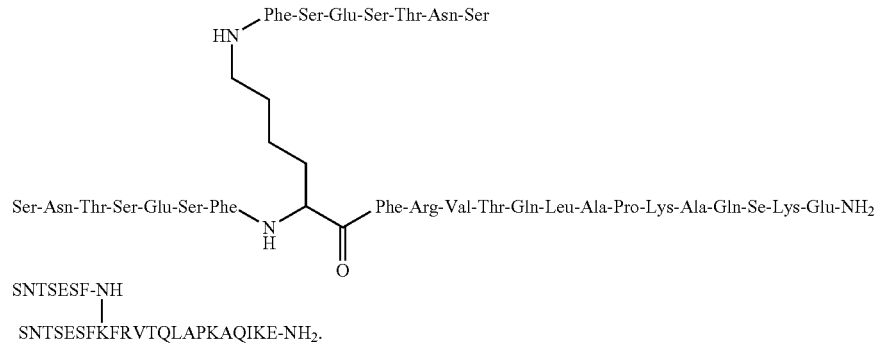

Pat. No. 8,008,449 and WO 2006/121168, the entire disclosures of which are hereby incorporated by reference. In illustrative embodiments, nivolumab or an antigen-binding fragment thereof comprises a heavy chain comprising the amino acid sequence of SEQ ID NO: 71; and/or a light chain comprising the amino acid sequence of SEQ ID NO: 72.

In an embodiment, the PD-1 targeting moiety comprises the anti-PD-1 antibody pidilizumab (aka CT-011, hBAT or hBAT-1), or fragments thereof. Pidilizumab and other humanized anti-PD-1 monoclonal antibodies are disclosed in US 2008/0025980 and WO 2009/101611, the entire disclosures of which are hereby incorporated by reference.

In illustrative embodiments, the anti-PD-1 antibody or an antigen-binding fragment thereof for use in the methods provided herein comprises a light chain variable regions comprising an amino acid sequence selected from SEQ ID NOS: 15-18 of US 2008/0025980 (SEQ ID No: 15 of US 2008/0025980 (SEQ ID NO:73); SEQ ID No: 16 of US 2008/0025980 (SEQ ID NO:74); SEQ ID No: 17 of US 2008/0025980 (SEQ ID NO:75); and SEQ ID No: 18 of US 2008/0025980 (SEQ ID NO:76)); and/or a heavy chain comprising an amino acid sequence selected from SEQ ID NOS: 20-24 of US 2008/0025980 (SEQ ID No: 20 of US 2008/0025980 (SEQ ID NO:77); SEQ ID No: 21 of US 2008/0025980 (SEQ ID NO:78); SEQ ID No: 22 of US 2008/0025980 (SEQ ID NO:79); SEQ ID No: 23 of US 2008/0025980 (SEQ ID NO:80); and SEQ ID No: 24 of US 2008/0025980 (SEQ ID NO:81)).

In an embodiment, the targeting moiety comprises a light chain comprising SEQ ID NO:18 of US 2008/0025980 (SEQ ID NO: 76) and a heavy chain comprising SEQ ID NO:22 of US 2008/0025980 (SEQ ID NO:79).

In an embodiment, the targeting moiety comprises AMP-514 (aka MEDI-0680).

In an embodiment, the targeting moiety comprises the PD-L2-Fc fusion protein AMP-224, which is disclosed in WO2010/027827 and WO 2011/066342, the entire disclosures of which are hereby incorporated by reference. In such an embodiment, the targeting moiety may include a targeting domain which comprises SEQ ID NO:4 of WO2010/027827 (SEQ ID NO:82) and/or the B7-DC fusion protein which comprises SEQ ID NO:83 of WO2010/027827 (SEQ ID NO:83).

In an embodiment, the targeting moiety comprises the peptide AUNP 12 or any of the other peptides disclosed in In an embodiment, the PD-1 targeting moiety comprises the anti-PD-1 antibody 1E3, or fragments thereof, as disclosed in US 2014/0044738, the entire disclosures of which are hereby incorporated by reference. In illustrative embodiments, 1E3 or an antigen-binding fragment thereof for use in the methods provided herein comprises a heavy chain variable region comprising the amino acid sequence of SEQ ID NO:85; and/or a light chain variable region comprising the amino acid sequence of SEQ ID NO:86.

In an embodiment, the PD-1 targeting moiety comprises the anti-PD-1 antibody 1E8, or fragments thereof, as disclosed in US 2014/0044738, the entire disclosures of which are hereby incorporated by reference. In illustrative embodiments, 1E8 or an antigen-binding fragment thereof for use in the methods provided herein comprises a heavy chain variable region comprising the amino acid sequence of SEQ ID NO:87; and/or a light chain variable region comprising the amino acid sequence of SEQ ID NO:88.

In an embodiment, the PD-1 targeting moiety comprises the anti-PD-1 antibody 1H3, or fragments thereof, as disclosed in US 2014/0044738, the entire disclosures of which are hereby incorporated by reference. In illustrative embodiments, 1H3 or an antigen-binding fragment thereof for use in the methods provided herein comprises a heavy chain variable region comprising the amino acid sequence of SEQ ID NO:89; and/or light chain variable region comprising the amino acid sequence of SEQ ID NO:90.

In an embodiment, the PD-1 targeting moiety comprises a VHH directed against PD-1 as disclosed, for example, in U.S. Pat. No. 8,907,065 and WO 2008/071447, the entire disclosures of which are hereby incorporated by reference. In illustrative embodiments, the VHHs against PD-1 comprise SEQ ID NOS: 347-351 of U.S. Pat. No. 8,907,065 (SEQ ID No: 347 of U.S. Pat. No. 8,907,065 (SEQ ID NO:91); SEQ ID No: 348 of U.S. Pat. No. 8,907,065 (SEQ ID NO:92); SEQ ID No: 349 of U.S. Pat. No. 8,907,065 (SEQ ID NO:93); SEQ ID No: 350 of U.S. Pat. No. 8,907,065 (SEQ ID NO:94); and SEQ ID No: 351 of U.S. Pat. No. 8,907,065 (SEQ ID NO:95)).

In an embodiment, the PD-1 targeting moiety comprises any one of the anti-PD-1 antibodies, or fragments thereof, as disclosed in US2011/0271358 and WO2010/036959, the entire contents of which are hereby incorporated by reference. In illustrative embodiments, the antibody or an antigen-binding fragment thereof for use in the methods provided herein comprises a heavy chain comprising an amino acid sequence selected from SEQ ID NOS: 25-29 of US2011/0271358: (SEQ ID No: 25 of US2011/0271358 (SEQ ID NO:96); SEQ ID No: 26 of US2011/0271358 (SEQ ID NO:97); SEQ ID No: 27 of US2011/0271358 (SEQ ID NO:98); SEQ ID No: 28 of US2011/0271358 (SEQ ID NO:99); and SEQ ID No: 29 of US2011/0271358 (SEQ ID NO:100)); and/or a light chain comprising an amino acid sequence selected from SEQ ID NOS: 30-33 of US2011/0271358 (SEQ ID No: 30 of US2011/0271358 (SEQ ID NO:101); SEQ ID No: 31 of US2011/0271358 (SEQ ID NO:102); SEQ ID No: 32 of US2011/0271358 (SEQ ID NO:103); and SEQ ID No: 33 of US2011/0271358 (SEQ ID NO:104)).

In various embodiments, the PD-1 targeting moiety comprises one or more antibodies directed against PD-1, or antibody fragments thereof, selected from TSR-042 (Tesaro, Inc.), REGN2810 (Regeneron Pharmaceuticals, Inc.), PDR001 (Novartis Pharmaceuticals), and BGB-A317 (BeiGene Ltd.)

In various embodiments, the present multi-specific chimeric protein or chimeric protein complex has one or more targeting moieties directed against PD-L1. In some embodiments, the chimeric protein or chimeric protein complex has one or more PD-L1 targeting moieties, which selectively bind a PD-L1 polypeptide. In some embodiments, the chimeric protein or chimeric protein complex comprises one or more antibodies, antibody derivatives or formats, peptides or polypeptides, or fusion proteins that selectively bind a PD-L1 polypeptide.

Programmed death-ligand 1 (PD-L1) also known as cluster of differentiation 274 (CD274) or B7 homolog 1 (B7-H1) is a type 1 transmembrane protein that has been speculated to play a major role in suppressing the immune system. PD-LI is upregulated on macrophages and dendritic cells (DC) in response to LPS and GM-CSF treatment, and on T cells and B cells upon TCR and B cell receptor signaling.

In various embodiments, the PD-L1 targeting moiety comprises an antigen recognition domain that recognizes an epitope present on PD-L1. In an embodiment, the antigen-recognition domain recognizes one or more linear epitopes present on PD-L1. As used herein, a linear epitope refers to any continuous sequence of amino acids present on PD-L1. In another embodiment, the antigen-recognition domain recognizes one or more conformational epitopes present on PD-L1. As used herein, a conformation epitope refers to one or more sections of amino acids (which may be discontinuous) which form a three-dimensional surface with features and/or shapes and/or tertiary structures capable of being recognized by an antigen recognition domain.

In various embodiments, the PD-L1 targeting moiety binds to the full-length and/or mature forms and/or isoforms and/or splice variants and/or fragments and/or any other naturally occurring or synthetic analogs, variants, or mutants of human PD-L1. In various embodiments, the PD-L1 targeting moiety binds to any forms of the human PD-L1. In an embodiment, the PD-L1 targeting moiety binds to a phosphorylated form of PD-L1. In an embodiment, the PD-L1 targeting moiety binds to an acetylated form of PD-L1.

In an embodiment, the PD-L1 targeting moiety comprises an antigen recognition domain that recognizes one or more epitopes present on human PD-L1. In an embodiment, the human PD-L1 comprises the amino acid sequence of (signal peptide underlined):

```
Isoform 1:
                                      (SEQ ID NO: 520)
MRIFAVFIFMTYWHLLNAFTVTVPKDLYWEYGSNMTIECKFPVEKQLDLA

ALIVYWEMEDKNIIQFVHGEEDLKVQHSSYRQRARLLKDQLSLGNAALQI

TDVKLQDAGVYRCMISYGGADYKRITVKVNAPYNKINQRILVVDPVTSEH

ELTCQAEGYPKAEVIWTSSDHQVLSGKTTTTNSKREEKLFNVTSTLRINT

TTNEIFYCTFRRLDPEENHTAELVIPELPLAHPPNERTHLVILGAILLCL

GVALTFIFRLRKGRMMDVKKCGIQDTNSKKQSDTHLEET;

Isoform 2:
                                      (SEQ ID NO: 521)
MRIFAVFIFMTYWHLLNAPYNKINQRILVVDPVTSEHELTCQAEGYPKAE

VIWTSSDHQVLSGKTTTTNSKREEKLFNVTSTLRINTTTNEIFYCTFRRL

DPEENHTAELVIPELPLAHPPNERTHLVILGAILLCLGVALTFIFRLRKG

RMMDVKKCGIQDTNSKKQSDTHLEET;
or

Isoform 3:
                                      (SEQ ID NO: 522)
MRIFAVFIFMTYWHLLNAFTVTVPKDLYVVEYGSNMTIECKFPVEKQLDL

AALIVYWEMEDKNIIQFVHGEEDLKVQHSSYRQRARLLKDQLSLGNAALQ

ITDVKLQDAGVYRCMISYGGADYKRITVKVNAPYNKINQRILVVDPVTSE

HELTCQAEGYPKAEVIWTSSDHQVLSGD.
```

In various embodiments, the PD-L1 targeting moiety is capable of specific binding. In various embodiments, the PD-L1 targeting moiety comprises an antigen recognition domain such as an antibody or derivatives thereof. In an embodiment, the PD-L1 targeting moiety comprises an antibody. In various embodiments, the antibody is a full-length multimeric protein that includes two heavy chains and two light chains. Each heavy chain includes one variable region (e.g., $V_H$) and at least three constant regions (e.g., $CH_1$, $CH_2$ and $CH_3$), and each light chain includes one variable region ($V_L$) and one constant region ($C_L$). The variable regions determine the specificity of the antibody. Each variable region comprises three hypervariable regions also known as complementarity determining regions (CDRs) flanked by four relatively conserved framework regions (FRs). The three CDRs, referred to as CDR1, CDR2, and CDR3, contribute to the antibody binding specificity. In some embodiments, the antibody is a chimeric antibody. In some embodiments, the antibody is a humanized antibody.

In some embodiments, the PD-L1 targeting moiety comprises an antibody derivative or format. In some embodiments, the PD-L1 targeting moiety comprises a single-domain antibody, a recombinant heavy-chain-only antibody (VHH), a single-chain antibody (scFv), a shark heavy-chain-only antibody (VNAR), a microprotein (cysteine knot protein, knottin), a DARPin; a Tetranectin; an Affibody; a Transbody; an Anticalin; an AdNectin; an Affilin; an Affimer, a Microbody; an aptamer; an alterase; a plastic antibody; a phylomer; a stradobody; a maxibody; an evibody; a fynomer, an armadillo repeat protein, a Kunitz domain, an avimer, an atrimer, a probody, an immunobody, a triomab, a troybody; a pepbody; a vaccibody, a UniBody; a DuoBody, a Fv, a Fab, a Fab', a F(ab')$_2$, a peptide mimetic molecule, or a synthetic molecule, as described in U.S. Pat. Nos. or Patent Publication Nos. U.S. Pat. No. 7,417,130, US 2004/132094, U.S. Pat. No. 5,831,012, US 2004/023334, U.S. Pat. Nos. 7,250,297, 6,818,418, US 2004/209243, U.S. Pat. Nos. 7,838,629, 7,186,524, 6,004,746, 5,475,096, US 2004/146938, US 2004/157209, U.S. Pat. Nos. 6,994,982, 6,794,144, US 2010/239633, U.S. Pat. No. 7,803,907, US 2010/119446, and/or U.S. Pat. No. 7,166,697, the contents of which are hereby incorporated by reference in their entireties. See also, Storz MAbs. 2011 May-June; 3(3): 310-317.

In some embodiments, the PD-L1 targeting moiety comprises a single-domain antibody, such as a VHH. The VHH may be derived from, for example, an organism that produces VHH antibody such as a camelid, a shark, or the VHH may be a designed VHH. VHHs are antibody-derived therapeutic proteins that contain the unique structural and functional properties of naturally-occurring heavy-chain antibodies. VHH technology is based on fully functional antibodies from camelids that lack light chains. These heavy-chain antibodies contain a single variable domain ($V_H H$) and two constant domains (CH2 and CH3).

In an embodiment, the PD-L1 targeting moiety comprises a VHH. In some embodiments, the VHH is a humanized VHH or camelized VHH.

In some embodiments, the VHH comprises a fully human $V_H$ domain, e.g. a HUMABODY (Crescendo Biologics, Cambridge, UK). In some embodiments, fully human $V_H$ domain, e.g. a HUMABODY is monovalent, bivalent, or trivalent. In some embodiments, the fully human $V_H$ domain, e.g. a HUMABODY is mono- or multi-specific such as monospecific, bispecific, or trispecific. Illustrative fully human $V_H$ domains, e.g. a HUMABODIES are described in, for example, WO2016/113555 and WO2016/113557, the entire disclosure of which is incorporated by reference.

In some embodiments, the PD-L1 targeting moiety comprises a VHH comprising a single amino acid chain having four "framework regions" or FRs and three "complementary determining regions" or CDRs. As used herein, "framework region" or "FR" refers to a region in the variable domain which is located between the CDRs. As used herein, "complementary determining region" or "CDR" refers to variable regions in VHHs that contains the amino acid sequences capable of specifically binding to antigenic targets.

In various embodiments, the PD-L1 targeting moiety comprises a VHH having a variable domain comprising at least one CDR1, CDR2, and/or CDR3 sequences. In various embodiments, the PD-L1 targeting moiety comprises a VHH having a variable region comprising at least one FR1, FR2, FR3, and FR4 sequences.

In some embodiments, the CDR1 sequence of the PD-L1 targeting moiety is selected from:

GFTLDYYAIG; (SEQ ID NO: 523)

GTIFSINHMD; (SEQ ID NO: 524)

GFTFDDYGMS; (SEQ ID NO: 525)

GFTLDYYAIN; (SEQ ID NO: 526)

GTIFSINRMD; (SEQ ID NO: 527)

GFTFSSYGMS; (SEQ ID NO: 528)

GKIFSGNDMG; (SEQ ID NO: 529)

GTIFSINRMD; (SEQ ID NO: 530)

GFTFSSYGMS; (SEQ ID NO: 531)

GFTFNDYAMS; (SEQ ID NO: 532)

GFNLDPYAIA; (SEQ ID NO: 533)

GFTFTAYAMS; (SEQ ID NO: 534)

GFTFDYYAIG; (SEQ ID NO: 535)

GFNLDPYAIA; (SEQ ID NO: 536)

GTIFSINRMD; (SEQ ID NO: 537)

GTIFSINRMD; (SEQ ID NO: 538)

GFTFSSYGMS; (SEQ ID NO: 539)

GFNLDPYAIG; (SEQ ID NO: 540)

GFNLDPYAIA; (SEQ ID NO: 541)

ESIFSIEAMG; (SEQ ID NO: 542)

GKIFSGNDMG; (SEQ ID NO: 543)

GFTLDYYAIG; (SEQ ID NO: 544)

GFTFSSYGMS; (SEQ ID NO: 545)

GTIFSINRMD; (SEQ ID NO: 546)

GFTFSSYGMS; (SEQ ID NO: 547)

GFNLDPYAIA; (SEQ ID NO: 548)

GRTFSISAMG; (SEQ ID NO: 549)

GFTLDYYAIN; (SEQ ID NO: 550)

GFTFSSYGMS; (SEQ ID NO: 551)

GFTFNDYAMS; (SEQ ID NO: 552)

GFTLDYYAIG; (SEQ ID NO: 553)

YYAIG; (SEQ ID NO: 554)

YYAKC; (SEQ ID NO: 555)

QYDVG; (SEQ ID NO: 556)

NSAMG; (SEQ ID NO: 557)

DSIVS; (SEQ ID NO: 558)

INHMD; (SEQ ID NO: 559)

DYGMS; (SEQ ID NO: 560)

YYAIN; (SEQ ID NO: 561)

INRMD; (SEQ ID NO: 562)

SYGMS; (SEQ ID NO: 563)

GNDMG; (SEQ ID NO: 564)

DYAMS; (SEQ ID NO: 565)

PYAIA; (SEQ ID NO: 566)

AYAMS; (SEQ ID NO: 567)

PYAIG; (SEQ ID NO: 568)

IEAMG; and (SEQ ID NO: 569)

ISAMG. (SEQ ID NO: 570)

In some embodiments, the CDR2 sequence of the PD-L1 targeting moiety is selected from:

ISSSDGSTY; (SEQ ID NO: 571)

ITSDGFPT; (SEQ ID NO: 572)

IRWNGGSTN; (SEQ ID NO: 573)

ISSSDGSTY; (SEQ ID NO: 574)

ITSDGTPT; (SEQ ID NO: 575)

IDSGGGSTS; (SEQ ID NO: 576)

ITSGGITD; (SEQ ID NO: 577)

ITSDGTPT; (SEQ ID NO: 578)

IDSGGGSTS; (SEQ ID NO: 579)

IRSNGGYTN; (SEQ ID NO: 580)

ISSSDVGTY; (SEQ ID NO: 581)

INSSDGSTY; (SEQ ID NO: 582)

ISGSDSSTY; (SEQ ID NO: 583)

ISSSDVGTY; (SEQ ID NO: 584)

ITSDGTPT; (SEQ ID NO: 585)

ITSDGTPA; (SEQ ID NO: 586)

IDSGGGSTS; (SEQ ID NO: 587)

ISSGDGSKY; (SEQ ID NO: 588)

ISSSDVGTY; (SEQ ID NO: 589)

IFGGGFTN; (SEQ ID NO: 590)

ITSGGITD; (SEQ ID NO: 591)

ISSSDGSTY; (SEQ ID NO: 592)

IDSGGGSTS; (SEQ ID NO: 593)

ITSDGTPT; (SEQ ID NO: 594)

IDSGGGSTS; (SEQ ID NO: 595)

ISSSDVGTY; (SEQ ID NO: 596)

ITWSGGSTS; (SEQ ID NO: 597)

ISSSDGSTY; (SEQ ID NO: 598)

IDSGGGSTS; (SEQ ID NO: 599)

IRSNGGYTN; (SEQ ID NO: 600)

ISSSDGSTY; (SEQ ID NO: 601)

SISSSDGSTYYADSVKG; (SEQ ID NO: 602)

CISSSDGSTYYADSVKG; (SEQ ID NO: 603)

CISGGDNSTYYADSVKG; (SEQ ID NO: 604)

FSSSGGRTIYPDSVKG; (SEQ ID NO: 605)

RITGGGLIAYTDSVKG; (SEQ ID NO: 606)

GISNGGTIKYAESVLG; (SEQ ID NO: 607)

-continued

LITSDGFPT; (SEQ ID NO: 608)

LITSDGFPTYADSAKG; (SEQ ID NO: 609)

AIRWNGGSTN; (SEQ ID NO: 610)

AIRWNGGSTNYADSVKG; (SEQ ID NO: 611)

LITSDGTPT; (SEQ ID NO: 612)

LITSDGTPTYADSAKG (SEQ ID NO: 613)

AIDSGGGSTS; (SEQ ID NO: 614)

AIDSGGGSTSYADSVKG; (SEQ ID NO: 615)

IITSGGITD; (SEQ ID NO: 616)

IITSGGITDYADAVKG; (SEQ ID NO: 617)

GIRSNGGYTN; (SEQ ID NO: 618)

GIRSNGGYTNYADSVKG; (SEQ ID NO: 619)

CISSSDVGTY; (SEQ ID NO: 620)

CISSSDVGTYYADSVKG; (SEQ ID NO: 621)

CINSSDGSTY; (SEQ ID NO: 622)

CINSSDGSTYYADSVKG; (SEQ ID NO: 623)

CISGSDSSTY; (SEQ ID NO: 624)

CISGSDSSTYYADSVKG; (SEQ ID NO: 625)

LITSDGTPA; (SEQ ID NO: 626)

LITSDGTPAYADSAKG (SEQ ID NO: 627)

CISSGDGSKY; (SEQ ID NO: 628)

CISSGDGSKYYADSVKG; (SEQ ID NO: 629)

AIFGGGFTN; (SEQ ID NO: 630)

AIFGGGFTNYADSVKG (SEQ ID NO: 631)

AITWSGGSTS; and (SEQ ID NO: 632)

AITWSGGSTSYTDSVKG. (SEQ ID NO: 633)

In some embodiments, the CDR3 sequence of the PD-L1 targeting moiety is selected from:

DGWSSCRHGIN-EYLYW; (SEQ ID NO: 634)

SSGVYNYW; (SEQ ID NO: 635)

QGYY-CSGYGCPR; (SEQ ID NO: 636)

SGWRLCRPTDEYDYSYW; (SEQ ID NO: 637)

SSGVYNYW; (SEQ ID NO: 638)

QGYYCSGYGCSDYW; (SEQ ID NO: 639)

RDRTIWW; (SEQ ID NO: 640)

SSGVYNYW; (SEQ ID NO: 641)

QGYY-CSGYGCSDYW (SEQ ID NO: 642)

QGYYCSGYGCYP; (SEQ ID NO: 643)

DGYYYCSDYPHPLYW (SEQ ID NO: 644)

DGWRDCTWSNEYAYW; (SEQ ID NO: 645)

TGWRTCRGLNEYDYW; (SEQ ID NO: 646)

DGYYYCSDYPHPLYW (SEQ ID NO: 647)

SSGVYNYW; (SEQ ID NO: 648)

SSGVYNYW; (SEQ ID NO: 649)

QGYYCSGYGCSDYW; (SEQ ID NO: 650)

DGYYYCSDYPHPLYW (SEQ ID NO: 651)

DGYYYCSDYPHPLYW (SEQ ID NO: 652)

DLVSGSSRLYDYW; (SEQ ID NO: 653)

RDRTIWW; (SEQ ID NO: 654)

DGWSSCRHGINEYLYW; (SEQ ID NO: 655)

QGYYCSGYGCSDYW; (SEQ ID NO: 656)

SSGVYNYW; (SEQ ID NO: 657)

QGYYCSGYGCSDYW; (SEQ ID NO: 658)

DGYYYCSDYPHPLYW (SEQ ID NO: 659)

-continued

MGRTNYGVIYDPNMYNYW;  (SEQ ID NO: 660)

SGWRLCRPTDEYDYLYW;  (SEQ ID NO: 661)

QGYYCSGYGCSDYW;  (SEQ ID NO: 662)

QGYYCSGYGCYP;  (SEQ ID NO: 663)

DGWSSCRHGINEYLYW;  (SEQ ID NO: 664)

SQAPITIATMMKPFYDY;  (SEQ ID NO: 665)

RHGGPLTVEYFFDY;  (SEQ ID NO: 666)

GGWKYCSGYDPEYIY  (SEQ ID NO: 667)

DINYLNSY;  (SEQ ID NO: 668)

INSRDG;  (SEQ ID NO: 669)
and

RQY.

In various illustrative embodiments, the PD-L1 targeting moiety comprises an amino acid sequence selected from the following sequences:

2LIG2
(SEQ ID NO: 670)
QVQLQESGGGLVQAGGSLRLSCAASGFTLDYYAIGWFRQAPGKEREEVSCISSSDGSTYYADSVKGRFTISRDN
AKNTVNLQMNSLKPEDTAVYYCATDGWSSCRHGIN-EYLYWGQGTQVTVSSAAAYPYDVPDYGSHHHHHH

2LIG3
(SEQ ID NO: 671)
QVQLQESGGGLVQAGGSLRLSCTASGTIFSINHMDWFRQAPGKQRELVALITSDGFPTYADSAKGRFTISRDNT
KKTVSLQMNSLKPEDTAVYYCHVSSGVYNYWGQGTQVTVSSAAAYPYDVPDYGSHHHHHH;

2LIG16
(SEQ ID NO: 672)
QVQLQESGGGLVQPGGSLRLSCAASGFTFDDYGMSWVRQAPGKGLESWVSAIRWNGGSTNYADSVKGRFTISR
DNAKNTLYLQMNSLKSEDTAVYYCA-QGYY-CSGYGCPRGQGTQVTVSSAAAYPYDVPDYGSHHHHHH;

2LIG22
(SEQ ID NO: 673)
QVQLQESGGGLVQPGGSLRLSCAASGFTLDYYAINWFRQAPGKEREEVSCISSSDGSTYYADSVKGRFTISRDN
AKNTVYLQMNSLKPEDTAVYYCATSGWRLCRPTDEYDYSYWGQGTQVTVSSAAAYPYDVPDYGSHHHHHH;

2LIG27
(SEQ ID NO: 674)
QVQLQESGGGVVQAGGSLRLSCTASGTIFSINRMDWFRQAPGKQRELVALITSDGTPTYADSAKGRFTISRDNT
KKTVSLQMNSLKPEDTAVYYCHVSSGVYNYWGQGTQVTVSSAAAYPYDVPDYGSHHHHHH;

2LIG29
(SEQ ID NO: 675)
QVQLQESGGGLVQTGGSLRLSCAASGFTFSSYGMSWVRQTPGKGPESWVSAIDSGGGSTSYADSVKGRFTISR
DNAKNTLYLQMNSLKPEDTAVYYCA-QGYY-CSGYGCSDYWGQGTQVTVSSAAAYPYDVPDYGSHHHHHH;

2LIG30
(SEQ ID NO: 676)
QVQLQESGGGLVQPGGSLRLSCAASGKIFSGNDMGWYRQAPGKQRELVGIITSGGITDYADAVKGRFTISRDNA
KNMMYLQMNSLKPEDTAVYYCNMRDRTIWWGQGTQVTVSSAAAYPYDVPDYGSHHHHHH;

2LIG34
(SEQ ID NO: 677)
QVQLQESGGGSVQAGGSLRLSCTASGTIFSINRMDWFRQAPGKQRELVALITSDGTPTYADSAKGRFTISRDNT
KKTVSLQMNSLKPEDTAVYYCHVSSGVYNYWGQGTQVTVSSAAAYPYDVPDYGSHHHHHH;

2LIG35
(SEQ ID NO: 678)
QVQLQESGGGLVQPGGSLRLSCAASGFTFSSYGMSWVRQTPGKGPESWVSAIDSGGGSTSYADSVKGRFTTSR
DNAKNTLYLQMNSLKPEDTAVYYCA-QGYY-CSGYGCSDYWGQGTQVTVSSAAAYPYDVPDYGSHHHHHH;

2LIG48
(SEQ ID NO: 679)
QVQLQESGGGLVQPGGSLRLSCAASGFTFNDYAMSWVRQAPGKGLESWVSGIRSNGGYTNYADSVKGRFTISR
DNAKNTLYLQMNSLKSEDTAVYYCA-QGYY-CSGYGCYPGQGTQVTVSSAAAYPYDVPDYGSHHHHHH;

-continued

2LIG65
(SEQ ID NO: 680)
QVQLQESGGGLVQAGGSLRLSCAASGFNLDPYAIAWFRQAPGKEREEVSCISSSDVGTYYADSVKGRFTISRDN
AKKTVYLQMNSLKPEDTAVYYCATDGYYYCSDYPHPLYWGQGTQVTVSSAAAYPYDVPDYGSHHHHHH;

2LIG85
(SEQ ID NO: 681)
QVQLQESGGGLVQPGGSLRLSCAASGFTFTAYAMSWFRQAPGKEREEVSCINSSDGSTYYADSVKGRFTISRD
NAKNTVYLQMNSLKPEDTAVYHCATDGWRDCTWSNEYAYWGQGTQVTVSSAAAYPYDVPDYGSHHHHHH;

2LIG86
(SEQ ID NO: 682)
QVQLQESGGGLVQPGGSLRLSCAASGFTFDYYAIGWFRQAPGKEREEVSCISGSDSSTYYADSVKGRFTIVRDN
AQNTVYLQMNSLKPEDTAIYYCAVTGWRTCRGLNEYDYWGQGTQVTVSSAAAYPYDVPDYGSHHHHHH;

2LIG89
(SEQ ID NO: 683)
QVQLQESGGGLVQPGGSLRLSCAASGFNLDPYAIWFRQAPGKEREEVSCISSSDVGTYYADSVKGRFTISRDN
TKKTVYLQMNSLKPEDTAVYYCATDGYYYCSDYPHPLYWGQGTQVTVSSAAAYPYDVPDYGSHHHHHH;

2LIG97
(SEQ ID NO: 684)
QVQLQESGGGLVQAGESLRLSCTASGTIFSINRMDWFRQAPGKQRELVALITSDGTPTYADSAKGRFTISRDNTK
KTVSLQMNSLKPEDTAVYYCHVSSGVYNYWGQGTQVTVSSAAAYPYDVPDYGSHHHHHH;

2LIG99
(SEQ ID NO: 685)
QVQLQESGGGLVQAGGSLRLSCTASGTIFSINRMDWFRQAPGKQRELVALITSDGTPAYADSAKGRFTISRDNT
KKTVSLQMNSLKPEDTAVYYCHVSSGVYNYWGQGTQVTVSSAAAYPYDVPDYGSHHHHHH;

2LIG109
(SEQ ID NO: 686)
QVQLQESGGGLVQSGGSLRLSCKTSGFTFSSYGMSWVRQTPGKGPESWVSAIDSGGGSTSYADSVKGRFTISR
DNAKNTLYLQMNSLKPEDTAVYYCAQGYY-CSGYGCSDYWGQGTQVTVSSAAAYPYDVPDYGSHHHHHH;

2LIG127
(SEQ ID NO: 687)
QVQLQESGGGLVQPGGSLRLSCAASGFNLDPYAIGWFRQAPGKEREEVSCISSGDGSKYYADSVKGRFTMSRD
NAKKTVYLQMNSLKPEDTAVYYCATDGYYYCSDYPHPLYWGQGTQVTVSSAAAYPYDVPDYGSHHHHHH;

2LIG139
(SEQ ID NO: 688)
QVQLQESGGGLVQPGGSLRLSCAVSGFNLDPYAIAWFRQAPGKEREEVSCISSSDVGTYYADSVKGRFTISRDN
AKKTVYLQMNSLKPEDTAVYYCATDGYYYCSDYPHPLYWGQGTQVTVSSAAAYPYDVPDYGSHHHHHH;

2LIG176
(SEQ ID NO: 689)
QVQLQESGGGLVQAGGSLRLSCAASESIFSIEAMGWYRQAPGKQRELVAAIFGGGFTNYADSVKGRFTISRDNA
NRTVYLQMNSLKPEDTAVYYCNADLVSGSSRLYDYWGQGTQVTVSSAAAYPYDVPDYGSHHHHHH;

2LIG189
(SEQ ID NO: 690)
QVQLQESGGGLVQAGGSLRLSCAASGKIFSGNDMGWYRQAPGKQRELVGIITSGGITDYADAVKGRFTISRDNA
KNMMYLQMNSLKPEDTAVYYCNMRDRTIWWGQGTQVTVSSAAAYPYDVPDYGSHHHHHH;

3LIG3
(SEQ ID NO: 691)
QVQLQESGGGLVQPGGSLRLSCAASGFTLDYYAIGWFRQAPGKEREEVSCISSSDGSTYYADSVKGRFTISRDN
AKNTVNLQMNSLKPEDTAVYYCATDGWSSCRHGINEYLYWGQGTQVTVSSAAAYPYDVPDYGSHHHHHH;

3LIG7
(SEQ ID NO: 692)
QVQLQESGGGLVQAGGSLRLSCAASGFTFSSYGMSWVRQTPGKGPESWVSAIDSGGGSTSYADSVKGRFTISR
DNAKNTLYLQMNSLKPEDTAVYYCAQGYY-CSGYGCSDYWGQGTQVTVSSAAAYPYDVPDYGSHHHHHH;

```
3LIG8
                                                                 (SEQ ID NO: 693)
QVQLQESGGGLVQPGGSLRLSCTASGTIFSINRMDWFRQAPGKQRELVALITSDGTPTYADSAKGRFTISRDNT

KKTVSLQMNSLKPEDTAVYYCHVSSGVYNYWGQGTQVTVSSAAAYPYDVPDYGSHHHHHH;

3LIG9
                                                                 (SEQ ID NO: 694)
QVQLQESGGGLVQPGGSLRLSCAASGFTFSSYGMSWVRQTPGKGPESWVSAIDSGGGSTSYADSVKGRFTISR

DNAKNTLYLQMNSLKPEDTAVYYCAQGYYCSGYGCSDYWGQGTQVTVSSAAAYPYDVPDYGSHHHHHH;

3LIG18
                                                                 (SEQ ID NO: 695)
QVQLQESGGGLVQPGGSLRLSCAASGFNLDPYAIAWFRQAPGKEREEVSCISSSDVGTYYADSVKGRFTISRDN

AKKTVYLQMNSLKPEDTAVYYCATDGYYYCSDYPHPLYWGQGTQVTVSSAAAYPYDVPDYGSHHHHHH;

3LIG20
                                                                 (SEQ ID NO: 696)
QVQLQESGGGLVXAGGSLRLSCAASGRTFSISAMGWFRQAPGKEREFVAAITWSGGSTSYTDSVKGRFTISRD

NAKNTLYLQMNSLKPEDTAIYYCAAMGRTNYGVIYDPNMYNYWGQGTQVTVSSAAAYPYDVPDYGSHHHHHH;

3LIG28
                                                                 (SEQ ID NO: 697)
QVQLQESGGGLVQPGGSLRLSCAASGFTLDYYAINWFRQAPGKEREEVSCISSSDGSTYYADSVKGRFTISRDN

AKNTVYLQMNSLKPEDTAVYYCATSGWRLCRPTDEYDYLYWGQGTQVTVSSAAAYPYDVPDYGSHHHHHH;

3LIG29
                                                                 (SEQ ID NO: 698)
QVQLQESGGGLVQAGGSMRLSCAASGFTFSSYGMSWVRQTPGKGPESWVSAIDSGGGSTSYADSVKGRFTISR

DNAKNTLYLQMNSLKPEDTAVYYCAQGYYCSGYGCSDYWGQGTQVTVSSAAAYPYDVPDYGSHHHHHH;

3LIG30
                                                                 (SEQ ID NO: 699)
QVQLQESGGGTVQAGGSLRLSCAASGFTFNDYAMSWVRQAPGKGLESWVSGIRSNGGYTNYADSVKGRFTISR

DNAKNTLYLQMNSLKSEDTAVYYCAQGYYCSGYGCYPGQGTQVTVSSAAAYPYDVPDYGSHHHHHH;
or

3LIG33
                                                                 (SEQ ID NO: 700)
QVQLQESGGGLVQPGTSLRLSCAASGFTLDYYAIGWFRQAPGKEREEVSCISSSDGSTYYADSVKGRFTISRDN

AKNTVNLQMNSLKPEDTAVYYCATDGWSSCRHGINEYLYWGQGTQVTVSSAAAYPYDVPDYGSHHHHHH.
```

In various illustrative embodiments, the PD-L1 targeting moiety comprises an amino acid sequence selected from any one of the above sequences without the terminal histidine tag sequence (i.e., HHHHHH; SEQ ID NO: 327).

In some embodiments, the PD-L1 targeting moiety comprises an amino acid sequence selected from SEQ ID Nos: 670-700 (provided above) without the HA tag (i.e., YPYDVPDYGS; SEQ ID NO: 328).

In some embodiments, the PD-L1 targeting moiety comprises an amino acid sequence selected from SEQ ID Nos: 670-700 (provided above) without the AAA linker.

In some embodiments, the PD-L1 targeting moiety comprises an amino acid sequence selected from SEQ ID Nos: 670-700 (provided above) without the AAA linker, HA tag, and terminal histidine tag sequence (i.e., AAAYPYDVPDYGSHHHHHH; SEQ ID NO: 329).

In an embodiment, the PD-L1 targeting moiety comprises the anti-PD-L1 antibody MEDI4736 (aka durvalumab), or fragments thereof. MEDI4736 is selective for PD-L1 and blocks the binding of PD-L1 to the PD-1 and CD80 receptors. MEDI4736 and antigen-binding fragments thereof for use in the methods provided herein comprises a heavy chain and a light chain or a heavy chain variable region and a light chain variable region. The sequence of MEDI4736 is disclosed in WO/2016/06272, the entire contents of which are hereby incorporated by reference. In illustrative embodiments, MEDI4736 or an antigen-binding fragment thereof for use in the methods provided herein comprises a heavy chain comprising the amino acid sequence of SEQ ID NO:105; and/or a light chain comprising the amino acid sequence of SEQ ID NO:106.

In illustrative embodiments, the MEDI4736 or an antigen-binding fragment thereof for use in the methods provided herein comprises a heavy chain variable region comprising the amino acid sequence of SEQ ID NO:4 of WO/2016/06272 (SEQ ID NO:107); and/or a light chain variable region comprising the amino acid sequence of SEQ ID NO:3 of WO/2016/06272 (SEQ ID NO:108).

In an embodiment, the targeting moiety comprises the anti-PD-L1 antibody atezolizumab (aka MPDL3280A, RG7446), or fragments thereof. In illustrative embodiments, atezolizumab or an antigen-binding fragment thereof for use in the methods provided herein comprises a heavy chain comprising the amino acid sequence of SEQ ID NO:109; and/or a light chain comprising the amino acid sequence of SEQ ID NO: 110.

In an embodiment, the targeting moiety comprises the anti-PD-L1 antibody avelumab (aka MSB0010718C), or fragments thereof. In illustrative embodiments, avelumab or an antigen-binding fragment thereof for use in the methods provided herein comprises a heavy chain comprising the amino acid sequence of SEQ ID NO:111; and/or a light chain comprising the amino acid sequence of SEQ ID NO:112.

In an embodiment, the targeting moiety comprises the anti-PD-L1 antibody BMS-936559 (aka 12A4, MDX-1105), or fragments thereof, as disclosed in US 2013/0309250 and WO2007/005874, the entire disclosures of which are hereby incorporated by reference. In illustrative embodiments, BMS-936559 or an antigen-binding fragment thereof for use in the methods provided herein comprises a heavy chain variable region comprising the amino acid sequence of SEQ ID NO:113; and/or a light chain variable region comprising the amino acid sequence of SEQ ID NO: 114.

In an embodiment, the targeting moiety comprises the anti-PD-L1 antibody 3G10, or fragments thereof, as disclosed in US 2013/0309250 and WO2007/005874, the entire disclosures of which are hereby incorporated by reference. In illustrative embodiments, 3G10 or an antigen-binding fragment thereof for use in the methods provided herein comprises a heavy chain variable region comprising the amino acid sequence of SEQ ID NO:115; and/or a light chain variable region comprising the amino acid sequence of SEQ ID NO:116.

In an embodiment, the targeting moiety comprises the anti-PD-L1 antibody 10A5, or fragments thereof, as disclosed in US 2013/0309250 and WO2007/005874, the entire disclosures of which are hereby incorporated by reference. In illustrative embodiments, 10A5 or an antigen-binding fragment thereof for use in the methods provided herein comprises a heavy chain variable region comprising the amino acid sequence of SEQ ID NO:117; and/or a light chain variable region comprising the amino acid sequence of SEQ ID NO:118.

In an embodiment, the targeting moiety comprises the anti-PD-L1 antibody 5F8, or fragments thereof, as disclosed in US 2013/0309250 and WO2007/005874, the entire disclosures of which are hereby incorporated by reference. In illustrative embodiments, 5F8 or an antigen-binding fragment thereof for use in the methods provided herein comprises a heavy chain variable region comprising the amino acid sequence of SEQ ID NO: 119; and/or a light chain variable region comprising the amino acid sequence of SEQ ID NO:120.

In an embodiment, the targeting moiety comprises the anti-PD-L1 antibody 10H10, or fragments thereof, as disclosed in US 2013/0309250 and WO2007/005874, the entire disclosures of which are hereby incorporated by reference. In illustrative embodiments, 10H10 or an antigen-binding fragment thereof for use in the methods provided herein comprises a heavy chain variable region comprising the amino acid sequence of SEQ ID NO:121; and/or a light chain variable region comprising the amino acid sequence of SEQ ID NO:122.

In an embodiment, the targeting moiety comprises the anti-PD-L1 antibody 1B12, or fragments thereof, as disclosed in US 2013/0309250 and WO2007/005874, the entire disclosures of which are hereby incorporated by reference. In illustrative embodiments, 1B12 or an antigen-binding fragment thereof for use in the methods provided herein comprises a heavy chain variable region comprising the amino acid sequence of SEQ ID NO:123; and/or a light chain variable region comprising the amino acid sequence of SEQ ID NO:124.

In an embodiment, the targeting moiety comprises the anti-PD-L1 antibody 7H1, or fragments thereof, as disclosed in US 2013/0309250 and WO2007/005874, the entire disclosures of which are hereby incorporated by reference. In illustrative embodiments, 7H1 or an antigen-binding fragment thereof for use in the methods provided herein comprises a heavy chain variable region comprising the amino acid sequence of SEQ ID NO:125; and/or a light chain variable region comprising the amino acid sequence of SEQ ID NO:126.

In an embodiment, the targeting moiety comprises the anti-PD-L1 antibody 11E6, or fragments thereof, as disclosed in US 2013/0309250 and WO2007/005874, the entire disclosures of which are hereby incorporated by reference. In illustrative embodiments, 11E6 or an antigen-binding fragment thereof for use in the methods provided herein comprises a heavy chain variable region comprising the amino acid sequence of SEQ ID NO:127; and/or a light chain variable region comprising the amino acid sequence of SEQ ID NO:128.

In an embodiment, the targeting moiety comprises the anti-PD-L1 antibody 12B7, or fragments thereof, as disclosed in US 2013/0309250 and WO2007/005874, the entire disclosures of which are hereby incorporated by reference. In illustrative embodiments, 12B7 or an antigen-binding fragment thereof for use in the methods provided herein comprises a heavy chain variable region comprising the amino acid sequence of SEQ ID NO:129; and/or a light chain variable region comprising the amino acid sequence of SEQ ID NO:130.

In an embodiment, the targeting moiety comprises the anti-PD-L1 antibody 13G4, or fragments thereof, as disclosed in US 2013/0309250 and WO2007/005874, the entire disclosures of which are hereby incorporated by reference. In illustrative embodiments, 13G4 or an antigen-binding fragment thereof for use in the methods provided herein comprises a heavy chain variable region comprising the amino acid sequence of SEQ ID NO:131; and/or a light chain variable region comprising the amino acid sequence of SEQ ID NO:132.

In an embodiment, the targeting moiety comprises the anti-PD-L1 antibody 1E12, or fragments thereof, as disclosed in US 2014/0044738, the entire disclosures of which are hereby incorporated by reference. In illustrative embodiments, 1E12 or an antigen-binding fragment thereof for use in the methods provided herein comprises a heavy chain variable region comprising the amino acid sequence of SEQ ID NO:133; and/or a light chain variable region comprising the amino acid sequence of SEQ ID NO:134.

In an embodiment, the targeting moiety comprises the anti-PD-L1 antibody 1F4, or fragments thereof, as disclosed in US 2014/0044738, the entire disclosures of which are hereby incorporated by reference. In illustrative embodiments, 1F4 or an antigen-binding fragment thereof for use in the methods provided herein comprises a heavy chain variable region comprising the amino acid sequence of SEQ ID NO:135; and/or a light chain variable region comprising the amino acid sequence of SEQ ID NO:136.

In an embodiment, the targeting moiety comprises the anti-PD-L1 antibody 2G11, or fragments thereof, as disclosed in US 2014/0044738, the entire disclosures of which are hereby incorporated by reference. In illustrative embodiments, 2G11 or an antigen-binding fragment thereof for use in the methods provided herein comprises a heavy chain variable region comprising the amino acid sequence of SEQ ID NO:137; and/or a light chain variable region comprising the amino acid sequence of SEQ ID NO:138.

In an embodiment, the targeting moiety comprises the anti-PD-L1 antibody 3B6, or fragments thereof, as disclosed in US 2014/0044738, the entire disclosures of which are hereby incorporated by reference. In illustrative embodiments, 3B6 or an antigen-binding fragment thereof for use in the methods provided herein comprises a heavy chain variable region comprising the amino acid sequence of SEQ ID NO:139; and/or a light chain variable region comprising the amino acid sequence of SEQ ID NO:140.

In an embodiment, the targeting moiety comprises the anti-PD-L1 antibody 3D10, or fragments thereof, as disclosed in US 2014/0044738 and WO2012/145493, the entire disclosures of which are hereby incorporated by reference. In illustrative embodiments, 3D10 or an antigen-binding fragment thereof for use in the methods provided herein comprises a heavy chain variable region comprising the amino acid sequence of (SEQ ID NO:141; and/or alight chain variable region comprising the amino acid sequence of SEQ ID NO:142.

In an embodiment, the targeting moiety comprises any one of the anti-PD-L1 antibodies disclosed in US2011/0271358 and WO2010/036959, the entire contents of which are hereby incorporated by reference. In illustrative embodiments, the antibody or an antigen-binding fragment thereof for use in the methods provided herein comprises a heavy chain comprising an amino acid sequence selected from SEQ ID Nos: 34-38 of US2011/0271358 (SEQ ID No: 34 of US2011/0271358 (SEQ ID NO:143); SEQ ID No: 35 of US2011/0271358 (SEQ ID NO:144); SEQ ID No: 36 of US2011/0271358 (SEQ ID NO:145); SEQ ID No: 37 of US2011/0271358 (SEQ ID NO:146); and SEQ ID No: 38 of US2011/0271358 (SEQ ID NO:147)); and/or alight chain comprising an amino acid sequence selected from SEQ ID Nos: 39-42 of US2011/0271358 (SEQ ID No: 39 of US2011/0271358 (SEQ ID NO:148); SEQ ID No: 40 of US2011/0271358 (SEQ ID NO:149); SEQ ID No: 41 of US2011/0271358 (SEQ ID NO:150); and SEQ ID No: 42 of US2011/0271358 (SEQ ID NO:151)).

In an embodiment, the targeting moiety comprises the anti-PD-L1 antibody 2.7A4, or fragments thereof, as disclosed in WO 2011/066389, U.S. Pat. No. 8,779,108, and US2014/0356353, the entire disclosures of which are hereby incorporated by reference. In illustrative embodiments, 2.7A4 or an antigen-binding fragment thereof for use in the methods provided herein comprises a heavy chain variable region comprising the amino acid sequence of SEQ ID No: 2 of WO 2011/066389 (SEQ ID NO:152); and/or a light chain variable region comprising the amino acid sequence of SEQ ID No: 7 of WO 2011/066389 (SEQ ID NO:153).

In an embodiment, the targeting moiety comprises the anti-PD-L1 antibody 2.9D10, or fragments thereof, as disclosed in WO 2011/066389, U.S. Pat. No. 8,779,108, and US2014/0356353, the entire disclosures of which are hereby incorporated by reference. In illustrative embodiments, 2.9D10 or an antigen-binding fragment thereof for use in the methods provided herein comprises a heavy chain variable region comprising the amino acid sequence of SEQ ID No: 12 of WO 2011/066389 (SEQ ID NO:154); and/or a light chain variable region comprising the amino acid sequence of SEQ ID No: 17 of WO 2011/066389 (SEQ ID NO:155).

In an embodiment, the targeting moiety comprises the anti-PD-L1 antibody 2.14H9, or fragments thereof, as disclosed in WO 2011/066389, U.S. Pat. No. 8,779,108, and US2014/0356353, the entire disclosures of which are hereby incorporated by reference. In illustrative embodiments, 2.14H9 or an antigen-binding fragment thereof for use in the methods provided herein comprises a heavy chain variable region comprising the amino acid sequence of SEQ ID No: 22 of WO 2011/066389 (SEQ ID NO:156); and/or a light chain variable region comprising the amino acid sequence of SEQ ID No: 27 of WO 2011/066389 (SEQ ID NO:157).

In an embodiment, the targeting moiety comprises the anti-PD-L1 antibody 2.20A8, or fragments thereof, as disclosed in WO 2011/066389, U.S. Pat. No. 8,779,108, and US2014/0356353, the entire disclosures of which are hereby incorporated by reference. In illustrative embodiments, 2.20A8 or an antigen-binding fragment thereof for use in the methods provided herein comprises a heavy chain variable region comprising the amino acid sequence of SEQ ID No: 32 of WO 2011/066389 (SEQ ID NO:158); and/or a light chain variable region comprising the amino acid sequence of SEQ ID No: 37 of WO 2011/066389 (SEQ ID NO:159).

In an embodiment, the targeting moiety comprises the anti-PD-L1 antibody 3.15G8, or fragments thereof, as disclosed in WO 2011/066389, U.S. Pat. No. 8,779,108, and US2014/0356353, the entire disclosures of which are hereby incorporated by reference. In illustrative embodiments, 3.15G8 or an antigen-binding fragment thereof for use in the methods provided herein comprises a heavy chain variable region comprising the amino acid sequence of SEQ ID No: 42 of WO 2011/066389 (SEQ ID NO:160); and/or a light chain variable region comprising the amino acid sequence of SEQ ID No: 47 of WO 2011/066389 (SEQ ID NO:161).

In an embodiment, the targeting moiety comprises the anti-PD-L1 antibody 3.18G1, or fragments thereof, as disclosed in WO 2011/066389, U.S. Pat. No. 8,779,108, and US2014/0356353, the entire disclosures of which are hereby incorporated by reference. In illustrative embodiments, 3.18G1 or an antigen-binding fragment thereof for use in the methods provided herein comprises a heavy chain variable region comprising the amino acid sequence of SEQ ID No: 52 of WO 2011/066389 (SEQ ID NO:162); and/or a light chain variable region comprising the amino acid sequence of SEQ ID No: 57 of WO 2011/066389 (SEQ ID NO:163).

In an embodiment, the targeting moiety comprises the anti-PD-L1 antibody 2.7A40PT, or fragments thereof, as disclosed in WO 2011/066389, U.S. Pat. No. 8,779,108, and US2014/0356353, and US2014/0356353, the entire disclosures of which are hereby incorporated by reference. In illustrative embodiments, 2.7A40PT or an antigen-binding fragment thereof for use in the methods provided herein comprises a heavy chain variable region comprising the amino acid sequence of SEQ ID No: 62 of WO 2011/066389 (SEQ ID NO:164); and/or a light chain variable region comprising the amino acid sequence of SEQ ID No: 67 of WO 2011/066389 (SEQ ID NO:165).

In an embodiment, the targeting moiety comprises the anti-PD-L1 antibody 2.14H90PT, or fragments thereof, as disclosed in WO 2011/066389, U.S. Pat. No. 8,779,108, and US2014/0356353, the entire disclosures of which are hereby incorporated by reference. In illustrative embodiments, 2.14H90PT or an antigen-binding fragment thereof for use in the methods provided herein comprises a heavy chain variable region comprising the amino acid sequence of SEQ ID No: 72 of WO 2011/066389 (SEQ ID NO:166); and/or a light chain variable region comprising the amino acid sequence of SEQ ID No: 77 of WO 2011/066389 (SEQ ID NO:167).

In an embodiment, the targeting moiety comprises any one of the anti-PD-L1 antibodies disclosed in WO2016/061142, the entire contents of which are hereby incorporated by reference. In illustrative embodiments, the antibody or an antigen-binding fragment thereof for use in the methods provided herein comprises a heavy chain comprising an amino acid sequence selected from SEQ ID Nos: 18, 30, 38, 46, 50, 54, 62, 70, and 78 of WO2016/061142 (SEQ ID No:

18 of WO2016/061142 (SEQ ID NO:168); SEQ ID No: 30 of WO2016/061142 (SEQ ID NO:169); SEQ ID No: 38 of WO2016/061142 (SEQ ID NO:170); SEQ ID No: 46 of WO2016/061142 (SEQ ID NO:171); SEQ ID No: 50 of WO2016/061142 (SEQ ID NO:172); SEQ ID No: 54 of WO2016/061142 (SEQ ID NO:173); SEQ ID No: 62 of WO2016/061142 (SEQ ID NO:174); SEQ ID No: 70 of WO2016/061142 (SEQ ID NO:175); and SEQ ID No: 78 of WO2016/061142 (SEQ ID NO:176)); and/or a light chain comprising an amino acid sequence selected from SEQ ID Nos: 22, 26, 34, 42, 58, 66, 74, 82, and 86 of WO2016/061142; SEQ ID No: 22 of WO2016/061142 (SEQ ID NO:177); SEQ ID No: 26 of WO2016/061142 (SEQ ID NO:178); SEQ ID No: 34 of WO2016/061142 (SEQ ID NO:179); SEQ ID No: 42 of WO2016/061142 (SEQ ID NO:180); SEQ ID No: 58 of WO2016/061142 (SEQ ID NO:181); SEQ ID No: 66 of WO2016/061142 (SEQ ID NO:182); SEQ ID No: 74 of WO2016/061142 (SEQ ID NO:183); SEQ ID No: 82 of WO2016/061142 (SEQ ID NO:184); and SEQ ID No: 86 of WO2016/061142 (SEQ ID NO:185)).

In an embodiment, the targeting moiety comprises any one of the anti-PD-L1 antibodies disclosed in WO2016/022630, the entire contents of which are hereby incorporated by reference. In illustrative embodiments, the antibody or an antigen-binding fragment thereof for use in the methods provided herein comprises a heavy chain comprising an amino acid sequence selected from SEQ ID Nos: 2, 6, 10, 14, 18, 22, 26, 30, 34, 38, 42, and 46 of WO2016/022630 (SEQ ID No: 2 of WO2016/022630 (SEQ ID NO:186); SEQ ID No: 6 of WO2016/022630 (SEQ ID NO:187); SEQ ID No: 10 of WO2016/022630 (SEQ ID NO:188); SEQ ID No: 14 of WO2016/022630 (SEQ ID NO:189); SEQ ID No: 18 of WO2016/022630 (SEQ ID NO:190); SEQ ID No: 22 of WO2016/022630 (SEQ ID NO:191); SEQ ID No: 26 of WO2016/022630 (SEQ ID NO:192); SEQ ID No: 30 of WO2016/022630 (SEQ ID NO:193); SEQ ID No: 34 of WO2016/022630 (SEQ ID NO:194); SEQ ID No: 38 of WO2016/022630 (SEQ ID NO:195); SEQ ID No: 42 of WO2016/022630 (SEQ ID NO:196); and SEQ ID No: 46 of WO2016/022630 (SEQ ID NO:197)); and/or a light chain comprising an amino acid sequence selected from SEQ ID Nos: 4, 8, 12, 16, 20, 24, 28, 32, 36, 40, 44, and 48 of WO2016/022630 (SEQ ID No: 4 of WO2016/022630 (SEQ ID NO:198); SEQ ID No: 8 of WO2016/022630 (SEQ ID NO:199); SEQ ID No: 12 of WO2016/022630 (SEQ ID NO:200); SEQ ID No: 16 of WO2016/022630 (SEQ ID NO:201); SEQ ID No: 20 of WO2016/022630 (SEQ ID NO:202); SEQ ID No: 24 of WO2016/022630 (SEQ ID NO:203); SEQ ID No: 28 of WO2016/022630 (SEQ ID NO:204); SEQ ID No: 32 of WO2016/022630 (SEQ ID NO:205); SEQ ID No: 36 of WO2016/022630 (SEQ ID NO:206); SEQ ID No: 40 of WO2016/022630 (SEQ ID NO:207); SEQ ID No: 44 of WO2016/022630 (SEQ ID NO:208); and SEQ ID No: 48 of WO2016/022630 (SEQ ID NO:209)).

In an embodiment, the targeting moiety comprises any one of the anti-PD-L1 antibodies disclosed in WO2015/112900, the entire contents of which are hereby incorporated by reference. In illustrative embodiments, the antibody or an antigen-binding fragment thereof for use in the methods provided herein comprises a heavy chain comprising an amino acid sequence selected from SEQ ID Nos: 38, 50, 82, and 86 of WO 2015/112900 (SEQ ID No: 38 of WO2015/112900 (SEQ ID NO:210); SEQ ID No: 50 of WO 2015/112900 (SEQ ID NO:211); SEQ ID No: 82 of WO 2015/112900 (SEQ ID NO:212); and SEQ ID No: 86 of WO 2015/112900 (SEQ ID NO:213)); and/or a light chain comprising an amino acid sequence selected from SEQ ID Nos: 42, 46, 54, 58, 62, 66, 70, 74, and 78 of WO 2015/112900 (SEQ ID No: 42 of WO2015/112900 (SEQ ID NO:214); SEQ ID No: 46 of WO 2015/112900 (SEQ ID NO:215); SEQ ID No: 54 of WO 2015/112900 (SEQ ID NO:216); SEQ ID No: 58 of WO 2015/112900 (SEQ ID NO:217); SEQ ID No: 62 of WO 2015/112900 (SEQ ID NO:218); SEQ ID No: 66 of WO 2015/112900 (SEQ ID NO:219); SEQ ID No: 70 of WO 2015/112900 (SEQ ID NO:220); SEQ ID No: 74 of WO 2015/112900 (SEQ ID NO:221); and SEQ ID No: 78 of WO 2015/112900 (SEQ ID NO:222)).

In an embodiment, the targeting moiety comprises any one of the anti-PD-L1 antibodies disclosed in WO 2010/077634 and U.S. Pat. No. 8,217,149, the entire disclosures of which are hereby incorporated by reference. In illustrative embodiments, the anti-PD-L1 antibody or an antigen-binding fragment thereof for use in the methods provided herein comprises a heavy chain region comprising the amino acid sequence of SEQ ID No: 20 of WO 2010/077634 (SEQ ID NO:223); and/or a light chain variable region comprising the amino acid sequence of SEQ ID No: 21 of WO 2010/077634 (SEQ ID NO:224).

In an embodiment, the targeting moiety comprises any one of the anti-PD-L1 antibodies obtainable from the hybridoma accessible under CNCM deposit numbers CNCM I-4122, CNCM I-4080 and CNCM I-4081 as disclosed in US 20120039906, the entire disclosures of which are hereby incorporated by reference.

In an embodiment, the targeting moiety comprises a VHH directed against PD-L1 as disclosed, for example, in U.S. Pat. No. 8,907,065 and WO 2008/071447, the entire disclosures of which are hereby incorporated by reference. In illustrative embodiments, the VHHs against PD-L1 comprise SEQ ID NOS: 394-399 of U.S. Pat. No. 8,907,065 (SEQ ID No: 394 of U.S. Pat. No. 8,907,065 (SEQ ID NO:225); SEQ ID No: 395 of U.S. Pat. No. 8,907,065 (SEQ ID NO:226); SEQ ID No: 396 of U.S. Pat. No. 8,907,065 (SEQ ID NO:227); SEQ ID No: 397 of U.S. Pat. No. 8,907,065 (SEQ ID NO:228); SEQ ID No: 398 of U.S. Pat. No. 8,907,065 (SEQ ID NO:229); and SEQ ID No: 399 of U.S. Pat. No. 8,907,065 (SEQ ID NO:230)).

In various embodiments, the present invention contemplates the use of any natural or synthetic analogs, mutants, variants, alleles, homologs and orthologs (herein collectively referred to as "analogs") of the PD-1 or PD-L1 targeting moieties described herein. In various embodiments, the amino acid sequence of the PD-1 or PD-L1 targeting moiety further includes an amino acid analog, an amino acid derivative, or other non-classical amino acids.

In various embodiments, the PD-1 or PD-L1 targeting moiety comprises a targeting moiety comprising a sequence that is at least 60% identical to any one of the PD-1 or PD-L1 sequences disclosed herein. For example, the PD-1 or PD-L1 targeting moiety may comprise a sequence that is at least about 60%, at least about 61%, at least about 62%, at least about 63%, at least about 64%, at least about 65%, at least about 66%, at least about 67%, at least about 68%, at least about 69%, at least about 70%, at least about 71%, at least about 72%, at least about 73%, at least about 74%, at least about 75%, at least about 76%, at least about 77%, at least about 78%, at least about 79%, at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or 100% identical to any of the sequences disclosed herein (e.g. about 60%, or about 61%, or about 62%, or about 63%, or about 64%, or about 65%, or about 66%, or about 67%, or about 68%, or about 69%, or about 70%, or about 71%, or about 72%, or about 73%, or about 74%, or about 75%, or about 76%, or about 77%, or about 78%, or about 79%, or about 80%, or about 81%, or about 82%, or about 83%, or about 84%, or about 85%, or about 86%, or about 87%, or about 88%, or about 89%, or about 90%, or about 91%, or about 92%, or about 93%, or about 94%, or about 95%, or about 96%, or about 97%, or about 98%, about 99% or about 100% sequence identity to any one of the PD-1 or PD-L1 targeting moiety sequences disclosed herein).

In various embodiments, the PD-1 or PD-L1 targeting moiety comprises an amino acid sequence having one or more amino acid mutations with respect to any one of the PD-1 or PD-L1 sequences disclosed herein. In various embodiments, the PD-1 or PD-L1 targeting moiety comprises an amino acid sequence having one, or two, or three, or four, or five, or six, or seen, or eight, or nine, or ten, or fifteen, or twenty amino acid mutations with respect to any one of the sequences disclosed herein. In some embodiments, the one or more amino acid mutations may be independently selected from substitutions, insertions, deletions, and truncations.

In some embodiments, the amino acid mutations are amino acid substitutions, and may include conservative and/or non-conservative substitutions.

"Conservative substitutions" may be made, for instance, on the basis of similarity in polarity, charge, size, solubility, hydrophobicity, hydrophilicity, and/or the amphipathic nature of the amino acid residues involved. The 20 naturally occurring amino acids can be grouped into the following six standard amino acid groups: (1) hydrophobic: Met, Ala, Val, Leu, Ile; (2) neutral hydrophilic: Cys, Ser, Thr; Asn, Gln; (3) acidic: Asp, Glu; (4) basic: His, Lys, Arg; (5) residues that influence chain orientation: Gly, Pro; and (6) aromatic: Trp, Tyr, Phe.

As used herein, "conservative substitutions" are defined as exchanges of an amino acid by another amino acid listed within the same group of the six standard amino acid groups shown above. For example, the exchange of Asp by Glu retains one negative charge in the so modified polypeptide. In addition, glycine and proline may be substituted for one another based on their ability to disrupt α-helices.

As used herein, "non-conservative substitutions" are defined as exchanges of an amino acid by another amino acid listed in a different group of the six standard amino acid groups (1) to (6) shown above.

In various embodiments, the substitutions may also include non-classical amino acids. Illustrative non-classical amino acids include, but are not limited to, selenocysteine, pyrrolysine, N-formylmethionine β-alanine, GABA and δ-Aminolevulinic acid, 4-aminobenzoic acid (PABA), D-isomers of the common amino acids, 2,4-diaminobutyric acid, α-amino isobutyric acid, 4-aminobutyric acid, Abu, 2-amino butyric acid, γ-Abu, ε-Ahx, 6-amino hexanoic acid, Aib, 2-amino isobutyric acid, 3-amino propionic acid, ornithine, norleucine, norvaline, hydroxyproline, sarcosme, citrulline, homocitrulline, cysteic acid, t-butylglycine, t-butylalanine, phenylglycine, cyclohexylalanine, β-alanine, fluoro-amino acids, designer amino acids such as β methyl amino acids, C α-methyl amino acids, N α-methyl amino acids, and amino acid analogs in general.

In various embodiments, the amino acid mutation may be in the CDRs of the targeting moiety (e.g., the CDR1, CDR2 or CDR3 regions). In another embodiment, amino acid alteration may be in the framework regions (FRs) of the targeting moiety (e.g., the FR1, FR2, FR3, or FR4 regions).

Modification of the amino acid sequences may be achieved using any known technique in the art e.g., site-directed mutagenesis or PCR based mutagenesis. Such techniques are described, for example, in Sambrook et al., Molecular Cloning: A Laboratory Manual, Cold Spring Harbor Press, Plainview, N.Y., 1989 and Ausubel et al., Current Protocols in Molecular Biology, John Wiley & Sons, New York, N.Y., 1989.

In various embodiments, the mutations do not substantially reduce the present PD-1 or PD-L1 targeting moiety's capability to specifically bind to PD-1 or PD-L1. In various embodiments, the mutations do not substantially reduce the present PD-1 or PD-L1 targeting moiety's capability to specifically bind to PD-1 or PD-L1 and without functionally modulating (e.g., partially or fully neutralizing) PD-1 or PD-L1.

In various embodiments, the binding affinity of the PD-1 or PD-L1 targeting moiety for the full-length and/or mature forms and/or isoforms and/or splice variants and/or fragments and/or monomeric and/or dimeric forms and/or any other naturally occurring or synthetic analogs, variants, or mutants (including monomeric and/or dimeric forms) of human PD-1 or PD-L1 may be described by the equilibrium dissociation constant ($K_D$). In various embodiments, the PD-1 or PD-L1 targeting moiety binds to the full-length and/or mature forms and/or isoforms and/or splice variants and/or fragments and/or any other naturally occurring or synthetic analogs, variants, or mutants (including monomeric and/or dimeric forms) of human PD-1 or PD-L1 with a $K_D$ of less than about 1 uM, about 900 nM, about 800 nM, about 700 nM, about 600 nM, about 500 nM, about 400 nM, about 300 nM, about 200 nM, about 100 nM, about 90 nM, about 80 nM, about 70 nM, about 60 nM, about 50 nM, about 40 nM, about 30 nM, about 20 nM, about 10 nM, or about 5 nM, or about 1 nM.

In various embodiments, the PD-1 or PD-L1 targeting moiety binds but does not functionally modulate (e.g., partially or fully neutralize) the antigen of interest, i.e., PD-1 or PD-L1. For instance, in various embodiments, the PD-1 or PD-L1 targeting moiety simply targets the antigen but does not substantially functionally modulate (e.g. partially or fully inhibit, reduce or neutralize) a biological effect that the antigen has. In various embodiments, the targeting moiety of the PD-1 or PD-L1 targeting moiety binds an epitope that is physically separate from an antigen site that is important for its biological activity (e.g. an antigen's active site).

In various embodiments, these binding agents bind to, and functionally modulate (e.g. partially or fully neutralize) PD-1 or PD-L1.

In various embodiments, the present multi-specific chimeric protein or chimeric protein complex has one or more targeting moieties directed against PD-L2. In some embodiments, the chimeric protein or chimeric protein complex has one or more targeting moieties which selectively bind a PD-L2 polypeptide. In some embodiments, the chimeric protein or chimeric protein complex comprises one or more antibodies, antibody derivatives or formats, peptides or polypeptides, or fusion proteins that selectively bind a PD-L2 polypeptide.

In an embodiment, the targeting moiety comprises a VHH directed against PD-L2 as disclosed, for example, in U.S.

Pat. No. 8,907,065 and WO 2008/071447, the entire disclosures of which are hereby incorporated by reference. In illustrative embodiments, the VHHs against PD-1 comprise SEQ ID Nos: 449-455 of U.S. Pat. No. 8,907,065 (SEQ ID No: 449 of U.S. Pat. No. 8,907,065 (SEQ ID NO:231); SEQ ID No: 450 of U.S. Pat. No. 8,907,065 (SEQ ID NO:232); SEQ ID No: 451 of U.S. Pat. No. 8,907,065 (SEQ ID NO:233); SEQ ID No: 452 of U.S. Pat. No. 8,907,065 (SEQ ID NO:234); SEQ ID No: 453 of U.S. Pat. No. 8,907,065 (SEQ ID NO:235); SEQ ID No: 454 of U.S. Pat. No. 8,907,065 (SEQ ID NO:236); and SEQ ID No: 455 of U.S. Pat. No. 8,907,065 (SEQ ID NO:237)).

In some embodiments, the PD-L2 targeting moiety comprising an amino acid sequence selected from SEQ ID NOs: 231-237 having one or more substitutions at positions 11, 37, 44, 45, 47, 83, 84, 103, 104, and 108 (according to Kabat numbering). In some embodiments, the amino acid at position 11 is L, M, S, V, or W. In some embodiments, the amino acid at position 37 is F, Y, H, I, L, or V. In some embodiments, the amino acid at position 44 is G, E, A, D, Q, R, S, or L. In some embodiments, the amino acid at position 45 is L, R, C, I, L, P, Q, or V. In some embodiments, the amino acid at position 47 is W, L, F, A, G, I, M, R, S, V or Y. In some embodiments, the amino acid at position 83 is R, K, N, E, G, I, M, Q or T. In some embodiments, the amino acid at position 84 is P, A, L, R, S, T, D, or V. In some embodiments, the amino acid at position 103 is W, P, R, or S; 104-G or D. In some embodiments, the amino acid at position 108 is Q, L, or R.

In various embodiments, the PD-L2 targeting moiety comprises a VHH having a variable domain comprising at least one CDR1, CDR2, and/or CDR3 sequences. In various embodiments, the PD-L2 binding agent comprises a VHH having a variable region comprising at least one FR1, FR2, FR3, and FR4 sequences.

In some embodiments, the PD-L2 CDR1 sequence is selected from:

```
                            (SEQ ID NO: 701)
INAMG;

(SEQ ID NO: 702)
NYVSNYAMG;

(SEQ ID NO: 703)
IXVMG;

(SEQ ID NO: 704)
SGTMG;

(SEQ ID NO: 705)
YYGIG;

(SEQ ID NO: 706)
TYTMI;
and (SEQ ID NO: 707)
SYDMS.
```

In some embodiments, the PD-L2 CDR2 sequence is selected from:

```
                            (SEQ ID NO: 708)
SISSGGSTNYADSVKG;

(SEQ ID NO: 709)
SISNGDTINYADSVKG;

(SEQ ID NO: 710)
AITSGGRTNYSDSVKG;

(SEQ ID NO: 711)
SIPWSGGRTYYADSVKD;

(SEQ ID NO: 712)
FISGSDGSTYYAESVKG;

(SEQ ID NO: 713)
TIDKDGNTNYVDSVKG;
and (SEQ ID NO: 714)
TINSGGGITYRGSVKG.
```

In some embodiments, the PD-L2 CDR3 sequence is selected from:

```
                            (SEQ ID NO: 715)
DVYPQDYGLGYVEGKVYYGMDY;

(SEQ ID NO: 716)
HQVAGLT;

(SEQ ID NO: 717)
WNSGYPPVDY;

(SEQ ID NO: 718)
KERSTGWDFAS;

(SEQ ID NO: 719)
DPWGPPSIATMTSYEYKH;

(SEQ ID NO: 720)
HGSSA;
and (SEQ ID NO: 721)
GGSSYR.
```

In an embodiment, the targeting moiety comprises any one of the anti-PD-L2 antibodies disclosed in US2011/0271358 and WO2010/036959, the entire contents of which are hereby incorporated by reference. In illustrative embodiments, the antibody or an antigen-binding fragment thereof for use in the methods provided herein comprises a heavy chain comprising an amino acid sequence selected from SEQ ID Nos: 43-47 of US2011/0271358 (SEQ ID No: 43 of US2011/0271358 (SEQ ID NO:238); SEQ ID No: 44 of US2011/0271358 (SEQ ID NO:239); SEQ ID No: 45 of US2011/0271358 (SEQ ID NO:240); SEQ ID No: 46 of US2011/0271358 (SEQ ID NO:241); and SEQ ID No: 47 of US2011/0271358 (SEQ ID NO:242)); and/or a light chain comprising an amino acid sequence selected from SEQ ID Nos: 48-51 of US2011/0271358 (SEQ ID No: 48 of US2011/0271358 (SEQ ID NO:243); SEQ ID No: 49 of US2011/0271358 (SEQ ID NO:244); SEQ ID No: 50 of US2011/0271358 (SEQ ID NO:245); and SEQ ID No: 51 of US2011/0271358 (SEQ ID NO:246)).

In various embodiments, the targeting moieties of the invention may comprise a sequence that targets PD-L2, which is at least about 60%, at least about 61%, at least about 62%, at least about 63%, at least about 64%, at least about 65%, at least about 66%, at least about 67%, at least about 68%, at least about 69%, at least about 70%, at least about 71%, at least about 72%, at least about 73%, at least about 74%, at least about 75%, at least about 76%, at least about 77%, at least about 78%, at least about 79%, at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or 100% identical to any of the sequences disclosed herein (e.g. about 60%, or about 61%, or about 62%, or about 63%, or about 64%, or about 65%, or about 66%, or about 67%, or about 68%, or about 69%, or about 70%, or about 71%, or about 72%, or about 73%, or about 74%, or about 75%, or about 76%, or about 77%, or about 78%, or about 79%, or about 80%, or about 81%, or about 82%, or about 83%, or about 84%, or about 85%, or about 86%, or about 87%, or about 88%, or about 89%, or about 90%, or about 91%, or about 92%, or about 93%, or about 94%, or about 95%, or about 96%, or about 97%, or about 98%, about 99% or about 100% sequence identity with any of the PD-L2 targeting sequences disclosed herein).

In various embodiments, the targeting moieties of the invention may comprise any combination of heavy chain, light chain, heavy chain variable region, light chain variable region, complementarity determining region (CDR), and framework region sequences that target PD-L2 as disclosed herein.

Additional antibodies, antibody derivatives or formats, peptides or polypeptides, or fusion proteins that selectively bind or target PD-1, PD-L1 and/or PD-L2 are disclosed in WO 2011/066389, US 2008/0025980, US 2013/0034559, U.S. Pat. No. 8,779,108, US 2014/0356353, U.S. Pat. No. 8,609,089, US 2010/028330, US 2012/0114649, WO 2010/027827, WO 2011/066342, U.S. Pat. No. 8,907,065, WO 2016/062722, WO 2009/101611, WO2010/027827, WO 2011/066342, WO 2007/005874, WO 2001/014556, US2011/0271358, WO 2010/036959, WO 2010/077634, U.S. Pat. No. 8,217,149, US 2012/0039906, WO 2012/145493, US 2011/0318373, U.S. Pat. No. 8,779,108, US 20140044738, WO 2009/089149, WO 2007/00587, WO 2016061142, WO 2016,02263, WO 2010/077634, and WO 2015/112900, the entire disclosures of which are hereby incorporated by reference.

In various embodiments, the present multi-specific chimeric protein or chimeric protein complex has one or more targeting moieties directed against Clec9A. In various embodiments, the Clec9A targeting moiety is a protein-based agent capable of specific binding to Clec9A without functional modulation (e.g., partial or full neutralization) of Clec9A. Clec9A is a group V C-type lectin-like receptor (CTLR) expressed on the surface of a subset of dendritic cells (i.e., $BDCA_3$+ dendritic cells) specialized for the uptake and processing of materials from dead cells. Clec9A recognizes a conserved component within nucleated and non-nucleated cells, exposed when cell membranes are damaged. Clec9A is expressed at the cell surface as a glycosylated dimer and can mediate endocytosis, but not phagocytosis. Clec9A possesses a cytoplasmic immunoreceptor tyrosine-based activation-like motif that can recruit Syk kinase and induce pro-inflammatory cytokine production (see Huysamen et al. (2008), JBC, 283:16693-701).

In various embodiments, the Clec9A targeting moiety comprises an antigen recognition domain that recognizes an epitope present on Clec9A. In an embodiment, the antigen-recognition domain recognizes one or more linear epitopes present on Clec9A. As used herein, a linear epitope refers to any continuous sequence of amino acids present on Clec9A. In another embodiment, the antigen-recognition domain recognizes one or more conformational epitopes present on Clec9A. As used herein, a conformation epitope refers to one or more sections of amino acids (which may be discontinuous) which form a three-dimensional surface with features and/or shapes and/or tertiary structures capable of being recognized by an antigen recognition domain.

In various embodiments, the Clec9A targeting moiety may bind to the full-length and/or mature forms and/or isoforms and/or splice variants and/or fragments and/or any other naturally occurring or synthetic analogs, variants, or mutants of human Clec9A. In various embodiments, the Clec9A targeting moiety may bind to any forms of the human Clec9A, including monomeric, dimeric, heterodimeric, multimeric and associated forms. In an embodiment, the Clec9A targeting moiety binds to the monomeric form of Clec9A. In another embodiment, the Clec9A targeting moiety binds to a dimeric form of Clec9A. In a further embodiment, the Clec9A targeting moiety binds to glycosylated form of Clec9A, which may be either monomeric or dimeric.

In an embodiment, the Clec9A targeting moiety comprises an antigen recognition domain that recognizes one or more epitopes present on human Clec9A. In an embodiment, the human Clec9A comprises the amino acid sequence of:

(SEQ ID NO: 722)
MHEEEIYTSLQWDSPAPDTYQKCLSSNKCSGACCLVMVISCVFCMGLLTAS

IFLGVKLLQVSTIAMQQQEKLIQQERALLNFTEWKRSCALQMKYCQAFMQN

SLSSAHNSSPCPNNWIQNRESCYYVSEIWSIWHTSQENCLKEGSTLLQIES

KEEMDFITGSLRKIKGSYDYWVGLSQDGHSGRWLWQDGSSPSPGLLPAERS

QSANQVCGYVKSNSLLSSNCSTWKYFICEKYALRSSV.

In various embodiments, the Clec9A targeting moiety is capable of specific binding. In various embodiments, the Clec9A targeting moiety comprises an antigen recognition domain such as an antibody or derivatives thereof. In an embodiment, the Clec9A targeting moiety comprises an antibody. In various embodiments, the antibody is a full-length multimeric protein that includes two heavy chains and two light chains. Each heavy chain includes one variable region (e.g., $V_H$) and at least three constant regions (e.g., $CH_1$, $CH_2$ and $CH_3$), and each light chain includes one variable region ($V_L$) and one constant region ($C_L$). The variable regions determine the specificity of the antibody. Each variable region comprises three hypervariable regions also known as complementarity determining regions (CDRs) flanked by four relatively conserved framework regions (FRs). The three CDRs, referred to as CDR1, CDR2, and CDR3, contribute to the antibody binding specificity. In some embodiments, the antibody is a chimeric antibody. In some embodiments, the antibody is a humanized antibody.

In some embodiments, the Clec9A targeting moiety comprises an antibody derivative or format. In some embodiments, the Clec9A targeting moiety comprises a single-domain antibody, a recombinant heavy-chain-only antibody (VHH), a single-chain antibody (scFv), a shark heavy-chain-only antibody (VNAR), a microprotein (cysteine knot protein, knottin), a DARPin; a Tetranectin; an Affibody; a Transbody; an Anticalin; an AdNectin; an Affilin; an Affimer, a Microbody; an aptamer; an alterase; a plastic antibody; a phylomer; a stradobody; a maxibody; an evibody; a fynomer, an armadillo repeat protein, a Kunitz domain, an avimer, an atrimer, a probody, an immunobody, a triomab, a troybody; a pepbody; a vaccibody, a UniBody; a DuoBody, a Fv, a Fab, a Fab', a F(ab')$_2$, a peptide mimetic molecule, or a synthetic molecule, as described in U.S. Pat. Nos. or Patent Publication Nos. U.S. Pat. No. 7,417,130, US 2004/132094, U.S. Pat. No. 5,831,012, US 2004/023334, U.S. Pat. Nos. 7,250,297, 6,818,418, US 2004/209243, U.S.

Pat. Nos. 7,838,629, 7,186,524, 6,004,746, 5,475,096, US 2004/146938, US 2004/157209, U.S. Pat. Nos. 6,994,982, 6,794,144, US 2010/239633, U.S. Pat. No. 7,803,907, US 2010/119446, and/or U.S. Pat. No. 7,166,697, the contents of which are hereby incorporated by reference in their entireties. See also, Storz MAbs. 2011 May-June; 3(3): 310-317.

In some embodiments, the Clec9A binding agent comprises a targeting moiety which is a single-domain antibody, such as a VHH. The VHH may be derived from, for example, an organism that produces VHH antibody such as a camelid, a shark, or the VHH may be a designed VHH. VHHs are antibody-derived therapeutic proteins that contain the unique structural and functional properties of naturally-occurring heavy-chain antibodies. VHH technology is based on fully functional antibodies from camelids that lack light chains. These heavy-chain antibodies contain a single variable domain ($V_HH$) and two constant domains (CH2 and CH3).

In an embodiment, the Clec9A targeting moiety comprises a VHH. In some embodiments, the VHH is a humanized VHH or camelized VHH.

In some embodiments, the VHH comprises a fully human $V_H$ domain, e.g. a HUMABODY (Crescendo Biologics, Cambridge, UK). In some embodiments, fully human $V_H$ domain, e.g. a HUMABODY is monovalent, bivalent, or trivalent. In some embodiments, the fully human $V_H$ domain, e.g. a HUMABODY is mono- or multi-specific such as monospecific, bispecific, or trispecific. Illustrative fully human $V_H$ domains, e.g. a HUMABODIES are described in, for example, WO2016/113555 and WO2016/113557, the entire disclosure of which is incorporated by reference.

In some embodiments, the Clec9A targeting moiety comprises a VHH comprising a single amino acid chain having four "framework regions" or FRs and three "complementary determining regions" or CDRs. As used herein, "framework region" or "FR" refers to a region in the variable domain which is located between the CDRs. As used herein, "complementary determining region" or "CDR" refers to variable regions in VHHs that contains the amino acid sequences capable of specifically binding to antigenic targets.

In various embodiments, the Clec9A targeting moiety comprises a VHH having a variable domain comprising at least one CDR1, CDR2, and/or CDR3 sequences. In various embodiments, the Clec9A targeting moiety comprises a VHH having a variable region comprising at least one FR1, FR2, FR3, and FR4 sequences.

In some embodiments, the CDR1 sequence of the Clec9A targeting moiety is selected from:

GSISSINVMG; (SEQ ID NO: 723)

GSFSSINVMG; (SEQ ID NO: 724)

GSISSINIMG; (SEQ ID NO: 725)

GSISSINIMG; (SEQ ID NO: 726)

VSIFSINAMG; (SEQ ID NO: 727)

-continued

GSIFSLNAMG; (SEQ ID NO: 728)

GRTISNYDMA; (SEQ ID NO: 729)

GRTFTTSLMQ; (SEQ ID NO: 730)

ERNLRIYDMA; (SEQ ID NO: 731)

ERNLRSYDMA; (SEQ ID NO: 732)

GLTFSNYHMG; (SEQ ID NO: 733)

GLTFSSYHMG; (SEQ ID NO: 734)

GLTFSRYHMG; (SEQ ID NO: 735)

GLTLSSYYIA; (SEQ ID NO: 736)

GLTFSSYYTG; (SEQ ID NO: 737)

GLTLSSYHMG; (SEQ ID NO: 738)

GRTSSPYVTG; (SEQ ID NO: 739)

GFTFSGYVMS; (SEQ ID NO: 740)

GFTFSGYVMT; (SEQ ID NO: 741)

GFTFSGYLMS; (SEQ ID NO: 742)

GRISSINSMG; (SEQ ID NO: 743)

GSITSINAMG; (SEQ ID NO: 744)

GRFFRVNAMG; (SEQ ID NO: 745)

GSSDSINAMG; (SEQ ID NO: 746)

GSVFSINAWG; (SEQ ID NO: 747)

GSILSINSMG; (SEQ ID NO: 748)

VSISSINSMG; (SEQ ID NO: 749)

GRVFSINAMG; (SEQ ID NO: 750)

VNIDTLNSMA; (SEQ ID NO: 751)

GGISSINSMG; (SEQ ID NO: 752)

GSMHSVNSMA; (SEQ ID NO: 753)

GDISSINAMG; (SEQ ID NO: 754)

-continued

GSIFSIDAMG; (SEQ ID NO: 755)

GSIFSINAMG; (SEQ ID NO: 756)

GSIFSIAAMG; (SEQ ID NO: 757)

GNIASITAMG; (SEQ ID NO: 758)

GFTFDDYAIG; (SEQ ID NO: 759)

GSISSINAMG; (SEQ ID NO: 760)

VSIFRSYFMG; (SEQ ID NO: 761)

GSIVSINAIG; (SEQ ID NO: 762)

GSIFSINAMG; (SEQ ID NO: 763)

RSFSSFNAMG; (SEQ ID NO: 764)

GSFSSINAMG; (SEQ ID NO: 765)

GTSFSINGMA; (SEQ ID NO: 766)

GRTFSTYAMG; (SEQ ID NO: 767)

GSIFSINAMG; (SEQ ID NO: 768)

GRIFDINAMG; (SEQ ID NO: 769)

GTLFSINGMA; (SEQ ID NO: 770)

GSIDSINAMG; (SEQ ID NO: 771)

GRAFSTNSMG; (SEQ ID NO: 772)

GSIISINSMG; (SEQ ID NO: 773)

RNFFSINAMG; (SEQ ID NO: 774)

GRFFRVNAMG; (SEQ ID NO: 775)

GSIVSINSMG; (SEQ ID NO: 776)

GSIFSINAMG; (SEQ ID NO: 777)

GSIIGINSMG; (SEQ ID NO: 778)

GRTFPGYVMA; (SEQ ID NO: 779)

GSIFSINAMG; (SEQ ID NO: 780)

GRTFSINAMG; (SEQ ID NO: 781)

GRTLSSYTIG; (SEQ ID NO: 782)

GSFFSINAMG; (SEQ ID NO: 783)

GSIFSINSMG; (SEQ ID NO: 784)

GSIFSFNAMG; (SEQ ID NO: 785)

GSIFSINAMG; (SEQ ID NO: 786)

GRTFSTYAMA; (SEQ ID NO: 787)

GSFFSINAMG; (SEQ ID NO: 788)

VNIGSLNSMV; (SEQ ID NO: 789)

GRTLSNYAVG; (SEQ ID NO: 790)

GSISSINAMG; (SEQ ID NO: 791)

GRFFRVNAMG; (SEQ ID NO: 792)

GSVFSINAMG; (SEQ ID NO: 793)

GSIFEINSIG; (SEQ ID NO: 794)

GSIFNINSMG; (SEQ ID NO: 795)

VNIGTLNSMA; (SEQ ID NO: 796)

GSIFSINSMG; (SEQ ID NO: 797)

GRIGSINSMG; (SEQ ID NO: 798)

GSIFSFNAMG; (SEQ ID NO: 799)

GRISSINSMG; (SEQ ID NO: 800)

GRTLSNYAVA; (SEQ ID NO: 801)

GRIGSINSMG; (SEQ ID NO: 802)

RSFFSFNAMG; (SEQ ID NO: 803)

GRFFRVNAMG; (SEQ ID NO: 804)

GIIFSINAMG; (SEQ ID NO: 805)

GRTLSNYAVA; (SEQ ID NO: 806)

GRIFSVNAMG; (SEQ ID NO: 807)

GRTFSSYAMA; (SEQ ID NO: 808)

-continued

GSFSSINVMG; (SEQ ID NO: 809)

INSMG; (SEQ ID NO: 810)

INAMG; (SEQ ID NO: 811)

VNAMG; (SEQ ID NO: 812)

INAWG; (SEQ ID NO: 813)

LNSMA; (SEQ ID NO: 814)

VNSMA; (SEQ ID NO: 815)

IDAMG; (SEQ ID NO: 816)

IAAMG; (SEQ ID NO: 817)

SITAMG; (SEQ ID NO: 818)

DYAIG; (SEQ ID NO: 819)

SYFMG; (SEQ ID NO: 820)

INAIG; (SEQ ID NO: 821)

FNAMG; (SEQ ID NO: 822)

INGMA; (SEQ ID NO: 823)

TYAMG; (SEQ ID NO: 824)

TNSMG; (SEQ ID NO: 825)

GYVMA; (SEQ ID NO: 826)

SYTIG; (SEQ ID NO: 827)

TYAMA; (SEQ ID NO: 828)

LNSMV; (SEQ ID NO: 829)

NYAVG; (SEQ ID NO: 830)

INSIG; (SEQ ID NO: 831)

NYAVA; (SEQ ID NO: 832)

SYAMA; and (SEQ ID NO: 833)

INVMG. (SEQ ID NO: 834)

In some embodiments, the CDR2 sequence of the Clec9A targeting moiety is selected from:

RITNLGLPNYADWLKD; (SEQ ID NO: 835)

RITNLGLPNYADSVTG; (SEQ ID NO: 836)

RITNIGLPNYADSVKG; (SEQ ID NO: 837)

RITNLGLPNYADSVEG; (SEQ ID NO: 838)

AITSGGRVVYSDSVKG; (SEQ ID NO: 839)

AITSGGRTAYADSVKG; (SEQ ID NO: 840)

HITSDGRIVYADPVKG; (SEQ ID NO: 841)

RISGSGDRTDYADSVKG; (SEQ ID NO: 842)

SITWSTGNTHYADSVKG; (SEQ ID NO: 843)

VISSSGDSTHYSDFVKG; (SEQ ID NO: 844)

VITSSGDSTHYSDFVKG; (SEQ ID NO: 845)

QITWSDASIYYAGSVKG; (SEQ ID NO: 846)

QITWSDTSIYYAGSVKG; (SEQ ID NO: 847)

QITWSDGTTYYPGSVKG; (SEQ ID NO: 848)

QIRWSDDSTYYPGSVKG; (SEQ ID NO: 849)

QISWSDDSTYYADSVKG; (SEQ ID NO: 850)

TVSWGGVTYYADSVKG; (SEQ ID NO: 851)

SIGSGGGYPSYTDSVEG; (SEQ ID NO: 852)

SIGSGGGYPSYTGSVEG; (SEQ ID NO: 853)

HIGSGGGYPSYTDSVQG; (SEQ ID NO: 854)

HIGSGGGHATYTDSVEG; (SEQ ID NO: 855)

TIGSGGGITSYADSVKG; (SEQ ID NO: 856)

AITNGGAKTYADSVKG; (SEQ ID NO: 857)

AITSGGRLSYADSVKG; (SEQ ID NO: 858)

AITNGGQTAYADSVKG; (SEQ ID NO: 859)

AITSGGRSTYIDSAKG; (SEQ ID NO: 860)

-continued

AITNQGRIAYAPSVNG; (SEQ ID NO: 861)

AITNDGRTTYVDSVKG; (SEQ ID NO: 862)

AVTVGGRYAYADSAKN; (SEQ ID NO: 863)

AITNQGATTYADSVKG; (SEQ ID NO: 864)

GITGSGQITYANSVRG; (SEQ ID NO: 865)

AITNGGRTVYGDSVKG; (SEQ ID NO: 866)

AITSGGRLAYAPSVNG; (SEQ ID NO: 867)

AITNGGRTTYVDSVKG; (SEQ ID NO: 868)

AITTGGRTTYVDSVKG; (SEQ ID NO: 869)

AITNQGRLTYADSVKG; (SEQ ID NO: 870)

AITSGGRRAYADSVKG; (SEQ ID NO: 871)

AITSASASRTTYADSVKG; (SEQ ID NO: 872)

CISRSDGSTYYDDSVKG; (SEQ ID NO: 873)

AITNQGRVTYADSVKG; (SEQ ID NO: 874)

AITDGGRLAYADSAKG; (SEQ ID NO: 875)

SITNQGIRNYSTSVMG; (SEQ ID NO: 876)

AITNQGRTTYADSVKG; (SEQ ID NO: 877)

AITNGGRIAYGIAVNG; (SEQ ID NO: 878)

AITNGGRIAYSDSAKG; (SEQ ID NO: 879)

GITSDGSTGYADSVKG; (SEQ ID NO: 880)

AISWSGGSTYYADSVKG; (SEQ ID NO: 881)

AITDQGRLAYADSAKG; (SEQ ID NO: 882)

AITNGGQTTYADSVKG; (SEQ ID NO: 883)

GITSDGSTGYADSVKG; (SEQ ID NO: 884)

AITTGGRTAYVDSVKG; (SEQ ID NO: 885)

AITSQGRITLADSVKG; (SEQ ID NO: 886)

AITVDGRLAYADSAKH; (SEQ ID NO: 887)

AITNGGRIAYGTSVMG; (SEQ ID NO: 888)

AITNGGQIAYADSVKG; (SEQ ID NO: 889)

AITDQGRTTYADSVKG; (SEQ ID NO: 890)

GITTQGRITYGNSVRG; (SEQ ID NO: 891)

AITSGGRTTYVDSVKG; (SEQ ID NO: 892)

AINWRGGDTYYADSVKG; (SEQ ID NO: 893)

AITDGGAKTYADSVKG; (SEQ ID NO: 894)

AITNQGRLSYVDSVKG; (SEQ ID NO: 895)

AITNQGRRTYADSVKG; (SEQ ID NO: 896)

AITNGGRIAYTDSVKG; (SEQ ID NO: 897)

AITNGGRTTYADSVKG; (SEQ ID NO: 898)

AITDGGRLTYADSAKG; (SEQ ID NO: 899)

AITTGGRTTYVDSVKG; (SEQ ID NO: 900)

AISWSGGSTEYHDSVKG; (SEQ ID NO: 901)

AITNQGRIAYADSVKG; (SEQ ID NO: 902)

GITGSGQITYANSVRG; (SEQ ID NO: 903)

AINWSSGGISYSNSAKG; (SEQ ID NO: 904)

AITGQGRTTYADSVKG; (SEQ ID NO: 905)

AITNGGQIVYADSVKG; (SEQ ID NO: 906)

AITTQGRTTYEDSVKG; (SEQ ID NO: 907)

AITSGGITNYANSVQG; (SEQ ID NO: 908)

AITVGGRLAYADSAKG; (SEQ ID NO: 909)

GITGGGQITYANSVRG; (SEQ ID NO: 910)

AITSQGRSTYADSAKG; (SEQ ID NO: 911)

AITNGGATVYADSVKG; (SEQ ID NO: 912)

AITDGGRLTYADSAKN; (SEQ ID NO: 913)

AITNGGAKTYADSVKG; (SEQ ID NO: 914)

AINWSSGGISYSNAAKG; (SEQ ID NO: 915)

AITNGGATVYADSVKG; (SEQ ID NO: 916)

AITNGGRIAYGTSVMG; (SEQ ID NO: 917)

AITNGGQTAYADSVKG; (SEQ ID NO: 918)

AITNXGRTTYADSVKG; (SEQ ID NO: 919)

AIWWASGGISYANSAKG; (SEQ ID NO: 920)

AITNQGAPTYADSVKG; (SEQ ID NO: 921)

RITNLGLPNYADSVTG; (SEQ ID NO: 922)

RITNLGLPNYADSVKG; (SEQ ID NO: 923)

AITNGGAKT; (SEQ ID NO: 924)

AITSGGRLS; (SEQ ID NO: 925)

AITNGGQTA; (SEQ ID NO: 926)

AITSGGRST; (SEQ ID NO: 927)

ITNQGRIA; (SEQ ID NO: 928)

ITNQGRIAYAPSVNG; (SEQ ID NO: 929)

AITNDGRTT; (SEQ ID NO: 930)

AVTVGGRYA; (SEQ ID NO: 931)

AITNQGATT; (SEQ ID NO: 932)

GITGSGQIT; (SEQ ID NO: 933)

AITNGGRTV; (SEQ ID NO: 934)

AITSGGRLA; (SEQ ID NO: 935)

AITNGGRTT; (SEQ ID NO: 936)

AITTGGRTT; (SEQ ID NO: 937)

AITNQGRLT; (SEQ ID NO: 938)

AITSGGRRA; (SEQ ID NO: 939)

AITSASASRTT; (SEQ ID NO: 940)

CISRSDGSTY; (SEQ ID NO: 941)

AITNQGRVT; (SEQ ID NO: 942)

AITDGGRLA; (SEQ ID NO: 943)

SITNQGIRN; (SEQ ID NO: 944)

AITNQGRTT; (SEQ ID NO: 945)

AITNGGRIA; (SEQ ID NO: 946)

GITSDGSTG; (SEQ ID NO: 947)

AISWSGGSTY; (SEQ ID NO: 948)

AITDQGRLA; (SEQ ID NO: 949)

AITNGGQTT; (SEQ ID NO: 950)

AITTGGRTA; (SEQ ID NO: 951)

AITSQGRIT; (SEQ ID NO: 952)

AITVDGRLA; (SEQ ID NO: 953)

AITNGGQIA; (SEQ ID NO: 954)

AITDQGRTT; (SEQ ID NO: 955)

GITTQGRIT; (SEQ ID NO: 956)

AITSGGRTT; (SEQ ID NO: 957)

AINWRGGDTY; (SEQ ID NO: 958)

AITDGGAKT; (SEQ ID NO: 959)

AITNQGRLS; (SEQ ID NO: 960)

AITNQGRRT; (SEQ ID NO: 961)

AITDGGRLT; (SEQ ID NO: 962)

AISWSGGSTE; (SEQ ID NO: 963)

AITNQGRIA; (SEQ ID NO: 964)

AINWSSGGIS; (SEQ ID NO: 965)

AITGQGRTT; (SEQ ID NO: 966)

AITNGGQIV; (SEQ ID NO: 967)

AITTQGRTT; (SEQ ID NO: 968)

-continued

AITSGGITN; (SEQ ID NO: 969)

AITVGGRLA; (SEQ ID NO: 970)

GITGGGQIT; (SEQ ID NO: 971)

AITSQGRST; (SEQ ID NO: 972)

AITNGGATV; (SEQ ID NO: 973)

AITNXGRTT; (SEQ ID NO: 974)

AIWWASGGIS; (SEQ ID NO: 975)

AITNQGAPT; and (SEQ ID NO: 976)

RITNLGLPN. (SEQ ID NO: 977)

In some embodiments, the CDR3 sequence of the Clec9A targeting moiety is selected from:

VALSAEY; (SEQ ID NO: 978)

VALKAEY; (SEQ ID NO: 979)

VGLKAEY; (SEQ ID NO: 980)

KTKSAVLFGGMDY; (SEQ ID NO: 981)

YIRGEDY; (SEQ ID NO: 982)

KHYASNY; (SEQ ID NO: 983)

QDFGSPSF; (SEQ ID NO: 984)

QDFRSPDF; (SEQ ID NO: 985)

QIFGSPNF; (SEQ ID NO: 986)

LAIHGDY; (SEQ ID NO: 987)

NQIRQWP; (SEQ ID NO: 988)

NSIRQWP; (SEQ ID NO: 989)

NAIRQWP; (SEQ ID NO: 990)

RKVGGPDY; (SEQ ID NO: 991)

NTFGNVY; (SEQ ID NO: 992)

LGR;

VIK;

FTRRDDY; (SEQ ID NO: 993)

FQSSGID; (SEQ ID NO: 994)

WAADYQQY; (SEQ ID NO: 995)

WNRDRQQY; (SEQ ID NO: 996)

KPTPVYGSTVGDY; (SEQ ID NO: 997)

FTRDKDY; (SEQ ID NO: 998)

WDRDRQQY; (SEQ ID NO: 999)

FTRTDDY; (SEQ ID NO: 1000)

YDRSSTPY; (SEQ ID NO: 1001)

FTRGDDY; (SEQ ID NO: 1002)

LNSATTY; (SEQ ID NO: 1003)

YTRDEDY; (SEQ ID NO: 1004)

FTRDEDY; (SEQ ID NO: 1005)

KWYDPLVIEYYDN; (SEQ ID NO: 1006)

KADHNDY; (SEQ ID NO: 1007)

FRSGADDY; (SEQ ID NO: 1008)

EVPSTYSCSGFREDY; (SEQ ID NO: 1009)

FAASGMEY; (SEQ ID NO: 1010)

WTTDRQQY; (SEQ ID NO: 1011)

FAGWGKEDY; (SEQ ID NO: 1012)

FSPTGDY; (SEQ ID NO: 1013)

KPTPVYGSTVGDY; (SEQ ID NO: 1014)

KASPVYGSTVEDY; (SEQ ID NO: 1015)

STPRGDSY; (SEQ ID NO: 1016)

-continued

EAEGSREGNFYERS; (SEQ ID NO: 1017)

WDRDRQQY; (SEQ ID NO: 1018)

FTRSDDY; (SEQ ID NO: 1019)

STPRGDSY; (SEQ ID NO: 1020)

FTRDTDY; (SEQ ID NO: 1021)

WTTLGTF; (SEQ ID NO: 1022)

WVRDGQQY; (SEQ ID NO: 1023)

KAIPVYGSTVEDY; (SEQ ID NO: 1024)

KAAATHLSTVADY; (SEQ ID NO: 1025)

FGRFDDY; (SEQ ID NO: 1026)

WGVKTGPESGSGTL; (SEQ ID NO: 1027)

FTRDEDY; (SEQ ID NO: 1028)

RLTTEYDYAY; (SEQ ID NO: 1029)

FTRGNDY; (SEQ ID NO: 1030)

FQSSGID; (SEQ ID NO: 1031)

FSPTDDF; (SEQ ID NO: 1032)

KAIPIYGSTAEDY; (SEQ ID NO: 1033)

FSLTDDY; (SEQ ID NO: 1034)

WTRDRQQY; (SEQ ID NO: 1035)

FTRDEDF; (SEQ ID NO: 1036)

EVEGSGREGNFYGA; (SEQ ID NO: 1037)

PGWDY; (SEQ ID NO: 1038)

YDRSATAY; (SEQ ID NO: 1039)

ASSVLSGTVDY; (SEQ ID NO: 1040)

FAADGMEY; (SEQ ID NO: 1041)

KAAASYVSTVADY; (SEQ ID NO: 1042)

TAKDDY; (SEQ ID NO: 1043)

-continued

FTGWGKEDY; (SEQ ID NO: 1044)

WAADYQQY; (SEQ ID NO: 1045)

YDRSATPY; (SEQ ID NO: 1046)

WARDRQQY; (SEQ ID NO: 1047)

FTRGDDY; (SEQ ID NO: 1048)

WTKDRQQY; (SEQ ID NO: 1049)

FTRTYDY; (SEQ ID NO: 1050)

ASSILSGTVDY; (SEQ ID NO: 1051)

WAADYQQY; (SEQ ID NO: 1052)

KPAPVYGSTVGDY; (SEQ ID NO: 1053)

FAADGMEY; (SEQ ID NO: 1054)

FGSGGG; (SEQ ID NO: 1055)

ASSVLSGTADY; (SEQ ID NO: 1056)

FTRGDDY; (SEQ ID NO: 1057)
and

EAEGSREGNFYERS. (SEQ ID NO: 1058)

In an illustrative embodiment, the Clec9A binding agent comprises SEQ ID NO: 723, SEQ ID NO: 835, and SEQ ID NO: 978.

In an illustrative embodiment, the Clec9A binding agent comprises SEQ ID NO: 724, SEQ ID NO: 836, and SEQ ID NO: 979.

In an illustrative embodiment, the Clec9A binding agent comprises SEQ ID NO: 725, SEQ ID NO: 837, and SEQ ID NO: 979.

In an illustrative embodiment, the Clec9A binding agent comprises SEQ ID NO: 723, SEQ ID NO: 838, and SEQ ID NO: 980.

In an illustrative embodiment, the Clec9A binding agent comprises SEQ ID NO: 726, SEQ ID NO: 839, and SEQ ID NO: 981.

In an illustrative embodiment, the Clec9A binding agent comprises SEQ ID NO: 727, SEQ ID NO: 840, and SEQ ID NO: 982.

In an illustrative embodiment, the Clec9A binding agent comprises SEQ ID NO: 728, SEQ ID NO: 841, and SEQ ID NO: 983.

In an illustrative embodiment, the Clec9A binding agent comprises SEQ ID NO: 729, SEQ ID NO: 842, and SEQ ID NO: 984.

In an illustrative embodiment, the Clec9A binding agent comprises SEQ ID NO: 729, SEQ ID NO: 842, and SEQ ID NO: 985.

In an illustrative embodiment, the Clec9A binding agent comprises SEQ ID NO: 729, SEQ ID NO: 842, and SEQ ID NO: 986.

In an illustrative embodiment, the Clec9A binding agent comprises SEQ ID NO: 730, SEQ ID NO: 843, and SEQ ID NO: 987.

In an illustrative embodiment, the Clec9A binding agent comprises SEQ ID NO: 731, SEQ ID NO: 844, and SEQ ID NO: 988.

In an illustrative embodiment, the Clec9A binding agent comprises SEQ ID NO: 731, SEQ ID NO: 845, and SEQ ID NO: 989.

In an illustrative embodiment, the Clec9A binding agent comprises SEQ ID NO: 732, SEQ ID NO: 846, and SEQ ID NO: 990.

In an illustrative embodiment, the Clec9A binding agent comprises SEQ ID NO: 733, SEQ ID NO: 847, and SEQ ID NO: 991.

In an illustrative embodiment, the Clec9A binding agent comprises SEQ ID NO: 733, SEQ ID NO: 848, and SEQ ID NO: 991.

In an illustrative embodiment, the Clec9A binding agent comprises SEQ ID NO: 734, SEQ ID NO: 849, and SEQ ID NO: 991.

In an illustrative embodiment, the Clec9A binding agent comprises SEQ ID NO: 735, SEQ ID NO: 850, and SEQ ID NO: 991.

In an illustrative embodiment, the Clec9A binding agent comprises SEQ ID NO: 736, SEQ ID NO: 851, and SEQ ID NO: 991.

In an illustrative embodiment, the Clec9A binding agent comprises SEQ ID NO: 737, SEQ ID NO: 851, and SEQ ID NO: 991.

In an illustrative embodiment, the Clec9A binding agent comprises SEQ ID NO: 738, SEQ ID NO: 852, and SEQ ID NO: 992.

In an illustrative embodiment, the Clec9A binding agent comprises SEQ ID NO: 739, SEQ ID NO: 853, and LGR.

In an illustrative embodiment, the Clec9A binding agent comprises SEQ ID NO: 739, SEQ ID NO: 854, and LGR.

In an illustrative embodiment, the Clec9A binding agent comprises SEQ ID NO: 739, SEQ ID NO: 855, and LGR.

In an illustrative embodiment, the Clec9A binding agent comprises SEQ ID NO: 740, SEQ ID NO: 856, and LGR.

In an illustrative embodiment, the Clec9A binding agent comprises SEQ ID NO: 741, SEQ ID NO: 857, and VIK.

In various illustrative embodiments, the Clec9A binding agent comprises an amino acid sequence selected from the following sequences:

R2CHCL8
(SEQ ID NO: 1059)
QVQLVESGGGLVHPGGSLRLSCAASGSISSINVMGWYRQAPGKERELVARI

TNLGLPNYADWLKDRFTISRDNAKNTVYLQMNSLKPEDTAVYYCYLVALSA

EYWGQGTQVTVSS;

R1CHCL50
(SEQ ID NO: 1060)
QVQLVESGGGLVHPGGSLRLSCAASGSFSSINVMGWYRQAPGKERELVARI

TNLGLPNYADSVTGRFTISRDNAKNTVYLQMNSLKPEDTAVYYCYLVALKA

EYWGQGTQVTVSS;

-continued

R1CHCL21
(SEQ ID NO: 1061)
QVQLVESGGGLVHRGGSLRLSCAASGSISSINIMGWYRQAPGKERELVARI

TNIGLPNYADSVKGRFTISRDNAKSTVYLQMNSLNAEDTAVYYCYLVALKA

EYWGQGTQVTVSS;

R2CHCL87
(SEQ ID NO: 1062)
QVQLVESGGGLVQPGGSLRLSCAASGSISSINVMGWYRQAPGKERELVARI

TNLGLPNYADSVEGRFTISRDKDENTVYLEMNTLKPEDTAVYYCYLVGLKA

EYWGQGTQVTVSS;

R2CHCL24
(SEQ ID NO: 1063)
QVQLVESGGGLVQPGGSLRLSCAASGSSDSINAMGWYRQAPGKERELVAAI

TSGGRVVYSDSVKGRGTISRDNAKNTVYLQIASLKPEDTAVYYCNVKTKSA

VLFGGMDYWGKGTQVTVSS;

R2CHCL38
(SEQ ID NO: 1064)
QVQLVESGGGLVQPGGSLRLSCAASVSIFSINAMGWYRQAPGKERELVAAI

TSGGRTAYADSVKGRFTISRDNSKNTVYLQMDSLKPEDTDVYYCKAYIRGE

DYWGKGTQVTVSS;

R1CHCL16
(SEQ ID NO: 1065)
DVQLVESGGGLVQPGGSLRLSCAASGSIFSLNAMGWYRQAPGKERELVAHI

TSDGRIVYADPVKGRFTISRVDGKNMVTLQMNSLKPEDTAVYYCNAKHYAS

NYWGQGTQVTVSS;

R2CHCL10
(SEQ ID NO: 1066)
QVQLVESGGGSVQAGGSLRLSCAASGRTISNYDMAWSRQAPGKEREFVARI

SGSGDRTDYADSVKGRFTISRDNAKNTVYLQMNSLKPEDTAIYYCQIQDFG

SPSFSGQGTQVTVSS;

R1CHCL34
(SEQ ID NO: 1067)
DVQLVESGGGSVQAGGSLRLSCAASGRTISNYDMAWSRQAPGKEREFVARI

SGSGDRTDYADSVKGRFTISRDNAKNTVYLQMNSLKPEDTAIYYCQIQDFR

SPDFWSQGTQVTVSS;

R1CHCL82
(SEQ ID NO: 1068)
QVQLVESGGESVQAGGSLRLSCAASGRTISNYDMAWSRQAPGKEREFVARI

SGSGDRTDYADSVKGRFTISRDNAKNTVYLQMNSLKPEDTAIYNCQTQIFG

SPNFSGQGTQVTVSS;

R2CHCL3
(SEQ ID NO: 1069)
QVQLVESGGGLVQAGDSLRLSCAASGRTFTTSLMQWHRQAPGKEREFVASI

TWSTGNTHYADSVKGRFTISRDNARNTVYLQMNSLKPEDTAIYTCRVLAIH

GDYWGQGTQVTVSS;

R2CHCL69
(SEQ ID NO: 1070)
DVQLVESGGGLVQAGDSLRLSCAASERNLRIYDMAWYRQAPGKEREYVAVI

SSSGDSTHYSDFVKGRFTISRDNAKNTVSLQMDSLKPEDTAFYYCNVNQIR

QWPWGQGTQVTVSS;

R1CHCL56
(SEQ ID NO: 1071)
QVQLVESGGGLVQAGDSLRLSCAASERNLRIYDMAWYRQAPGKEREYVAVI
SSSGDSTHYSDFVKGRFTISRDNAKNTVSLQMDSLKPEDTAFYYCNVNSIR
QWPWGQGTQVTVSS;

R2CHCL32
(SEQ ID NO: 1072)
QVQLVESGGGLVQAGDSLRLSCTASERNLRSYDMAWWRQAPGKEREYVAVI
TSSGDSTHYSDFVKGRFTISRDNAKNTVSLQMDSLKPEDTASYYCNVNAIR
QWPWGQGTQVTVSS;

R2CHCL49
(SEQ ID NO: 1073)
DVQLVESGGGSVQAGGSLRLSCAISGLTFSNYHMGWYRQAPGREREFVAQI
TWSDASIYYAGSVKGRFTISRDNVKNIVYLQIDNLKPEDTAIYYCDARKVG
GPDYWGQGTQVTVSS;

R2CHCL53
(SEQ ID NO: 1074)
QVQLVESGGGLVQAGGSLTLSCAISGLTFSSYHMGWYRQAPGREREFVAQI
TWSDTSIYYAGSVKGRFTISRDNVKNIVYLQIDNLKPEDTAIYYCDARKVG
GPDYWGQGTQVTVSS;

R2CHCL22
(SEQ ID NO: 1075)
DVQLVESGGGLVQAGGSLRLSCAISGLTFSRYHMGWYRQAPGREREFVAQI
TWSDGTTYYPGSVKGRFTISRDNARNTVYLQIDNLKPEDTAIYYCDARKVG
GPDYWGQGTQVTVSS;

R2CHCL25
(SEQ ID NO: 1076)
QVQLVESGGGLVQAGGSLRLSCATSGLTLSSYYIAWYRQAPGREREFVAQI
RWSDDSTYYPGSVKGRFTISRDNARNTVYLRMDNLKPEDTARYYCDARKVG
GPDYWGQGTQVTVSS;

R2CHCL18
(SEQ ID NO: 1077)
DVQLVESGGGLVQAGGSLRLSCATSGLTFSSYYTGWYRQAPGREREFVAQI
SWSDDSTYYADSVKGRFTISRDNARNTVYLQMNNLKPGDTAIYYCDARKVG
GPDYWGQGTQVTVSS;

R1CHCL23
(SEQ ID NO: 1078)
DVQLVESGGGLVQAGGSLRLSCATSGLTLSSYHMGWYRQAPGREREFVAQI
SWSDDSTYYADSVKGRFTISRDNARNTVYLQMNNLKPEDTAIYYCDARKVG
GPDYWGQGTQVTVSS;

R1CHCL27
(SEQ ID NO: 1079)
DVQLVESGGGLVQAGGSLRLSCAASGRTSSPYVTGWYRQTPGKEREPVATV
SWGGVTYYADSVKGRFTISRDNAKNTVYLQMNALKPEDTAIYYCNVNTFGN
VYWGQGTQVTVSS;

R2CHCL13
(SEQ ID NO: 1080)
QVQLVESGGGLVQPGGSLRLSCAASGFTFSGYVMSWVRQAPGKGLEWVASI
GSGGGYPSYTDSVEGRFTISRDNAKNTLYLLMDNLKPDDTAVYYCEMLGRR
GQGTQVTVSS;

R2CHCL14
(SEQ ID NO: 1081)
QVQLVESGGGLVQPGGSLRLSCAASGFTFSGYVMSWVRQAPGKGLEWVASI
GSGGGYPSYTDSVEGRFTISRDNAKNTLYLQMNNLKPDDTAVYYCEMLGRR
GQGTQVTVSS;

R2CHCL42
(SEQ ID NO: 1082)
QVQLVESGGGLVQPGGSLRLSCAASGFTFSGYVMSWVRQAPGKGLEWVASI
GSGGGYPSYTGSVEGRFTISRDNAKNTLYLLMNNLKPDDTAVYYCEMLGRR
GQGTQVTVSS;

R2CHCL41
(SEQ ID NO: 1083)
QVQLVESGGGLVQPGGSLRLSCAASGFTFSGYVMSWVRQAPGKGLEWVAHI
GSGGGYPSYTDSVQGRFTISRDNAKNTLYLQMNNLKPEDTAVYYCEMLGRR
GQGTQVTVSS;

R2CHCL94
(SEQ ID NO: 1084)
QVQLVESGGGLVQPGGSLRLSCAASGFTFSGYVMTWVRQAPGKGLEWVAHI
GSGGGHATYTDSVEGRFTISRDNAKNTLYLQMNNLKAEDTAVYYCEFLGRR
GQGTQVTVSS;
or

R2CHCL27
(SEQ ID NO: 1085)
QVQLVESGGGLVQPGGSLRLSCAASGFTFSGYLMSWVRQAPGKGLEWVATI
GSGGGITSYADSVKGRFTISRDNAKNTLYLQMNNLKHEDTAVYYCETVIKR
GQGTQVTVSS.

In various illustrative embodiments, the Clec9A targeting moiety comprises an amino acid sequence selected from the following sequences:

1LEC 7
(SEQ ID NO: 1086)
QVQLQESGGGLVQPGGSLRLSCAASGRISSINSMGWYRQAPGNQRELVAAITNGGAKTYADSVKGRFTISTDNA
GNTVYLQMDSLRPEDTAVYYCKAFTRRDDYWGQGTQITVSSAAAYPYDVPDYGSHHHHHH
or

1LEC 9
(SEQ ID NO: 1087)
QVQLQESGGGLVQAGGSLRLSCAASGSITSINAMGWYRQAPGKQRELVAAITSGGRLSYADSVKGRFTISRDNA
ESTVALQMNSLKPEDTAVYSCAAFQSSGIDWGQGTQVTVSSAAAYPYDVPDYGSHHHHHH
or

-continued

1LEC 26
(SEQ ID NO: 1088)
QVQLQESGGGLVQPGGSLRLSCAASGRFFRVNAMGWYRQAPGKQRELVAAITNGGQTAYADSVKGRFTISKES

ARNTVHLQMSSLKPEDTAVYYCTIWAADYQQYWGQGTQVTVSSAAAYPYDVPDYGSHHHHHH
or

1LEC 27
(SEQ ID NO: 1089)
QVQLQESGGGLVQAGESLRLSCAASGSSDSINAMGWYRQAPGKQRELVAAITSGGRSTYIDSAKGRATISRDNA

RNTAYLQMSSLKAEDTAVYYCTIWNRDRQQYWGQGTQVTVSSAAAYPYDVPDYGSHHHHHH
or

1LEC 28
(SEQ ID NO: 1090)
QVQLQESGGGLVQSGGSLRLSCAASGSVFSINAWGWYRQAPGKQRELVAAITNQGRIAYAPSVNGRFTISRDS

AKNTVYLQMNSLKPEDTAVYYCNAKPTPVYGSTVGDYWGQGTQVTVSSAAAYPYDVPDYGSHHHHHH
or

1LEC 30
(SEQ ID NO: 1091)
QVQLQESGGGLVQAGGSLRLSCAASGSILSINSMGWYRPALGNQRELVAAITNDGRTTYVDSVKGRFTISRDNA

KNTVYLQMNSLKPEDTAVYWCKAFTRDKDYWGQGTQVTVSSAAAYPYDVPDYGSHHHHHH
or

1LEC 38
(SEQ ID NO: 1092)
QVQLQESGGGLVQTGGSLRLSCAASVSISSINSMGWYRQAPGKERELVAAVTVGGRYAYADSAKNRFTISRDD

AQNTVHLQMSSLRAEDTAVYYCTIWDRDRQQYWGXGTQVTVSSAAAYPYDVPDYGSHHHHHH
or

1LEC 42
(SEQ ID NO: 1093)
QVQLQESGGGLVQPGGSLRLSCAASGRVFSINAMGWYRQAPGKQRELVAAITNQGATTYADSVKGRFTISRDT

AGNTVYLQMNSLRPEDTAVHYCKAFTRTDDYWGQGTQVTVSSAAAYPYDVPDYGSHHHHHH
or

1LEC 51
(SEQ ID NO: 1094)
QVQLQESGGGLVQAGGSLRLSCAASVNIDTLNSMAWYRQAPGKQRELVAGITGSGQITYANSVRGRFTVSRDN

AKSTVYLQMNTLQPEDTAVYYCAAYDRSSTPYWGQGTQVTVSSAAAYPYDVPDYGSHHHHHH
or

1LEC 61
(SEQ ID NO: 1095)
QVQLQESGGGLVQPGGSLRLSCAASGGISSINSMGWYRQAPGNQRELVAAITNGGRTVYGDSVKGRFTISRDS

AGNTVHLQMDSLRPEDTGVYYCKAFTRGDDYWGQGTQVTVSSAAAYPYDVPDYGSHHHHHH
or

1LEC 62
(SEQ ID NO: 1096)
QVQLQESGGGLVQPGGFLSLSCAASGSMHSVNSMAWYRQVPGKQRELVAAITSGGRLAYAPSVNGRFTISRDY

AKNTIHLQMNSLEPEDTAVYYCAALNSATTYWGQGTQVTVSSAAAYPYDVPDYGSHHHHHH
or

1LEC 63
(SEQ ID NO: 1097)
QVQLQESGGGLVQAGGSLRLSCAATGDISSINAMGWHRPARGNERELVAAITNGGRTTYVDSVKGRFTISRDNA

KNTVYLQMNSLKPEDTAVYFCKAYTRDEDYWGQGTQVTVSSAAAYPYDVPDYGSHHHHHH
or

1LEC 64
(SEQ ID NO: 1098)
QVQLQESGGGLVRAGGSLRLSCAASGSIFSIDAMGWYRPAHGEQRELVAAITTGGRTTYVDSVKGRFTISRDNA

KNTVYLQMNSLKPEDTAVYFCKAFTRDEDYWGQGTQVTVSSAAAYPYDVPDYGSHHHHHH
or

-continued

1LEC 70
(SEQ ID NO: 1099)
QVQLQESGGGLVQPGGSLRLSCAASGSIFSINAMGWYRQAPGKQRELVAAITNQGRLTYADSVKGRFTISRDNA

KNTVFLQMDSLKPEDTAVYYCNAKWYDPLVIEYYDNWGQGTQVTVSSAAAYPYDVPDYGSHHHHHH
or

1LEC 84
(SEQ ID NO: 1100)
QVQLQESGGGLVQPGGSLRLSCAASGSIFSIAAMGWYRQAPGKQRELVAAITSGGRRAYADSVKGRFTISRDND

ENTVALQMNSLKPEDTDVYYCNAKADHNDYWGQGTQITVSSAAAYPYDVPDYGSHHHHHH
or

1LEC 88
(SEQ ID NO: 1101)
QVQLQESGGGLVQPGGSLRLSCAAIGNIASITAMGWYRQAPGKQRELVAAITSASASRTTYADSVKGRFTISRDN

AKNTVYLQMNSLQPEDTAVYYCKGFRSGADDYWGQGTQVTVSSAAAYPYDVPDYGSHHHHHH
or

1LEC 91
(SEQ ID NO: 1102)
QVQLQESGGGLVQPGGSLRLSCAASGFTFDDYAIGWFRQAPGKEHEGVSCISRSDGSTYYDDSVKGRFTISSD

NAKNTVYLQMNSLKPEDTAVYYCAAEVPSTYSCSGFREDYKGKGTQVTVSSAAAYPYDVPDYGSHHHHHH
or

1LEC 92
(SEQ ID NO: 1103)
QVQLQESGGGLVQPGGSLRLSCAASGSISSINAMGWYRQAPGNQRELVAAITNQGRVTYADSVKGRFTISRDG

AKNTVYLQMNSLKPEDTAVYYCKVFAASGMEYWGKGTQVTVSSAAAYPYDVPDYGSHHHHHH
or

1LEC 94
(SEQ ID NO: 1104)
QVQLQESGGGLVQAGESLRLSCAASVSIFRSYFMGWYRQAPGKQRELVAAITDGGRLAYADSAKGRFTISREDT

RNTVHLQMSSLKAEDTAVYYCTIWTTDRQQYWGQGTQVTVSSAAAYPYDVPDYGSHHHHHH
or

2LEC 6
(SEQ ID NO: 1105)
QVQLQESGGGWVQPGGSLRLSCAATGSIVSINAIGWYRQAPGKQRELVASITNQGIRNYSTSVMGRFTISRDDV

KNTVSLQMNSLKPEDSAVYYCKGFAGWGKEDYWGQGTQVTVSSAAAYPYDVPDYGSHHHHHH
or

2LEC 13
(SEQ ID NO: 1106)
QVQLQESGGGLVQAGASLRLSCAASGSIFSINAMGWYRQAPGKQRELVAAITNQGRTTYADSVKGRFTISRDNA

KNTVYLQMDSLEPEDTAIYYCKGFSPTGDYWGQGTQVTVSSAAAYPYDVPDYGSHHHHHH
or

2LEC 16
(SEQ ID NO: 1107)
QVQLQESGGGLVQPGGSLRLSCLASRSFSSFNAMGWYRQAPGKERELVAAITNGGRIAYGIAVNGRFTISRDNA

KNTVYLQMNSLKPEDTAVYYCNAKPTPVYGSTVGDYWGQGTQVTVSSAAAYPYDVPDYGSHHHHHH
or

2LEC 20
(SEQ ID NO: 1108)
QVQLQESGGGLVQAGGSLTLSCAASGSFSSINAMGYYRQAPGKQRELVAAITNGGRIAYSDSAKGRFTISRDSA

KNTMYLQMNSLKPEDTDVYYCNAKASPVYGSTVEDYWGQGTQVTVSSAAAYPYDVPDYGSHHHHHH
or

2LEC 23
(SEQ ID NO: 1109)
QVQLQESGGGLVQPGGSLRLSCAASGTSFSINGMAWYRQAPGGQRELVGGITSDGSTGYADSVKGRFTVSRD

NAKNTVYLQMNRLKPEDTAVYYCGTSTPRGDSYWGQGTQVTVSSAAAYPYDVPDYGSHHHHHH
or

-continued

2LEC 24
(SEQ ID NO: 1110)
QVQLQESGGGLVQAGGSLRLSCAASGRTFSTYAMGWFRQAPGKERGLVAAISWSGGSTYYADSVKGRFTIFRD

NAENTVYLQMNSLKPEDTAVYYCAAEAEGSGREGNFYERSWYQGQGTQVTVSSAAAYPYDVPDYGSHHHHHH
or

2LEC 26
(SEQ ID NO: 1111)
QVQLQESGGGLVETGGSLRLSCAASGSIFSINAMGWYRQAPGKQRELVAAITDQGRLAYADSAKGRFTISRENA

RNTLHLQMSSLKAEDTAVYYCTIWDRDRQQYWGQGTQVTVSSAAAYPYDVPDYGSHHHHHH
or

2LEC 38
(SEQ ID NO: 1112)
QVQLQESGGGLVQPGGSLRLSCAASGRIFDINAMGWYRQAPGKQRELVAAITNGGQTTYADSVKGRFTISRDN

AGNTVYLQMNSLRPEDTAVYYCKAFTRSDDYWGQGTQVTVSSAAAYPYDVPDYGSHHHHHH
or

2LEC 48
(SEQ ID NO: 1113)
QVQLQESGGGLVQAGGSLRLSCAASGTLFSINGMAWYRQAPGKRRELVGGITSDGSTGYADSVKGRFTISRDN

AKNTAYLQMNSLKPEDTAVYYCGTSTPRGDSYWGQGTQVTVSSAAAYPYDVPDYGSHHHHHH
or

2LEC 53
(SEQ ID NO: 1114)
QVQLQESGGGLVQAGGSLRLSCAASGSIDSINAMGWYRPALGEQRELVAAITTGGRTAYVDSVKGRFTISRDAA

KNTVYLQMNSLKPEDTAVYSCKAFTRDTDYWGQGTQVTVSSAAAYPYDVPDYGSHHHHHH
or

2LEC 54
(SEQ ID NO: 1115)
QVQLQESGGGLAQPGGSLQLSCAASGRAFSTNSMGWYRQASGKQRELVAAITSQGRITLADSVKGRFTISSDN

TKNTVFLQMNSLKPEDTAVYYCNAWTTLGTFGGQGTQVTVSSAAAYPYDVPDYGSHHHHHH
or

2LEC 55
(SEQ ID NO: 1116)
QVQLQESGGGLVQTGESLSLSCAVASGSIISINSMGWYRQAPEKQRELVAAITVDGRLAYADSAKHRFTISKESA

RNTVHLHMSSLKPEDTAVYYCTIWVRDGQQYWGQGTQVTVSSAAAYPYDVPDYGSHHHHHH
or

2LEC 59
(SEQ ID NO: 1117)
QVQLQESGGGLVQPGGSLRLSCAVSRNFFSINAMGWYRQAPGKQRELVAAITNGGRIAYGTSVMGRFTISRDD

AKNTVDLQMNSLRPEDTAVYYCNAKAIPVYGSTVEDYWGQGTQVTVSSAAAYPYDVPDYGSHHHHHH
or

2LEC 60
(SEQ ID NO: 1118)
QVQLQESGGGLVQPGGSLRLSCAASGRFFRVNAMGWYRQVPGKQRELVAAITNGGQIAYADSVKGRFTISRDS

AKNTVYLQMNSLKSEDTDVYYCNAKAAATHLSTVADYWGQGTQVTVSSAAAYPYDVPDYGSHHHHHH
or

2LEC 61
(SEQ ID NO: 1119)
QVQLQESGGGLVQPGGSLRLSCAASGSIVSINSMGWYRQAPGKQRELVAAITDQGRTTYADSVKGRFTISRDDA

KNKNTVYLQMNSLKAEDTAVYACKAFGRFDDYWGQGTQVTVSSAAAYPYDVPDYGSHHHHHH
or

2LEC 62
(SEQ ID NO: 1120)
QVQLQESGGGLVQPGGSLRLSCAAYGSIFSINAMGWYRQAPGKERELVAGITTQGRITYGNSVRGRFTISGDNA

KNTVYLQMKSLKPEDTAVYYCSAWGVKTGPESGSGTLEGQGTQVTVSSAAAYPYDVPDYGSHHHHHH
or

-continued

2LEC 63

(SEQ ID NO: 1121)
QVQLQESGGGLVQAGGSLRLSCAASGSIIGINSMGYYRTAPGKQRELVAAITSGGRTTYVDSVKGRFTISRDNAK

NTVYLQMNSLKPEDTAVYFCKAFTRDEDYWGQGTQVTVSSAAAYPYDVPDYGSHHHHHH
or

2LEC 67

(SEQ ID NO: 1122)
QVQLQESGGGLVQAGGSLRLSCAASGRTFPGYVMAWFRQSPGQEREFAAAINWRGGDTYYADSVKGRFTISR

DNVKNTVFLQMNSLKPEDTAVYFCAARLTTEYDYAYWGQGTQVTVSSAAAYPYDVPDYGSHHHHHH
or

2LEC 68

(SEQ ID NO: 1123)
QVQLQESGGGLVQPGESLRLSCAASGSIFSINAMGWYRQAPGKQRELVAAITDGGAKTYADSVKGRFTISTDNA

GNTVYLQMDSLRPEDTAVYYCKAFTRGNDYWGQGTQVTVSSAAAYPYDVPDYGSHHHHHH
or

2LEC 76

(SEQ ID NO: 1124)
QVQLQESGGGLVQAGESLRLSCVVSGRTFSINAMGWYRQAPGKQRELVAAITNQGRLSYVDSVKGRFTISRDN

AANTVYLQMNSLKPEDTAVYYCAAFQSSGIDWGQGTQVTVSSAAAYPYDVPDYGSHHHHHH
or

2LEC 83

(SEQ ID NO: 1125)
QVQLQESGGGLVQAGGSLRLSCAASGRTLSSYTIGWYRQAPGKQRELVAAITNQGRRTYADSVKGRFTISRDN

AKNTVYLQMDSLKSEDTAVYYCKGFSPTDDFWGQGTQVTVSSAAAYPYDVPDYGSHHHHHH
or

2LEC 88

(SEQ ID NO: 1126)
QVQLQESGGGLVQPGGSLRLSCTASGSFFSINAMGWYRQAPGNQRELVAAITNGGRIAYTDSVKGRFTISNDNA

KNTVYLQMNSLKPEDTDVYYCNAKAIPIYGSTAEDYWGQGTQVTVSSAAAYPYDVPDYGSHHHHHH
or

2LEC 89

(SEQ ID NO: 1127)
QVQLQESGGGLVQAGGSLRLSCAASGSIFSINSMGWYRQAPGKQRELVAAITNGGRTTYADSVKGRFTISRDNA

KNTVYLQMDSLKPEDTAVYYCKGFSLTDDYWGQGTQVTVSSAAAYPYDVPDYGSHHHHHH
or

2LEC 90

(SEQ ID NO: 1128)
QVQLQESGGGLVQTGGSLRLSCAASGSIFSFNAMGWYRQAPGKQRELVAAITDGGRLTYADSAKGRFTISRENT

RNTVHLQMSSLKAEDTADYYCTIWTRDRQQYWGQGTQVTVSSAAAYPYDVPDYGSHHHHHH
or

2LEC 93

(SEQ ID NO: 1129)
QVQLQESGGGLVQAGGSLRLSCAASGSIFSINAMGWYRPALGEQRELVAAITTGGRTTYVDSVKGRFSISRDNA

KNTVYLQMNSLKPEDTAVYFCKAFTRDEDFWGQGTQVTVSSAAAYPYDVPDYGSHHHHHH
or

2LEC 95

(SEQ ID NO: 1130)
QVQLQESGGGLVQAGGSLRLSCEASGRTFSTYAMAWFRQAPGKERDLVAAISWSGGSTEYHDSVKGRFTISRD

NTKNTVYLQMNSLKAEDTAVYYCAAEVEGSGREGNFYGASWYPGQGTQVTVSSAAAYPYDVPDYGSHHHHHH
or

3LEC 4

(SEQ ID NO: 1131)
QVQLQESGGGLVQPGGSLRLSCAASGSFFSINAMGWYRQAPGKQRELVAAITNQGRIAYADSVKGRFTISRDNA

KNTVYLQMNSLKPEDTAVYYCGRPGWDYWGQGTQVTVSSAAAYPYDVPDYGSHHHHHH
or

-continued

3LEC 6
(SEQ ID NO: 1132)
QVQLQESGGGLVQAGGSLRLSCVASVNIGSLNSMVWYRQSPGKQRELVAGITGSGQITYANSVRGRFTVSRDIA

KSTAYLQMNTLKPEDTAVYYCAAYDRSATAYWGQGTQVTVSSAAAYPYDVPDYGSHHHHHH
or

3LEC 9
(SEQ ID NO: 1133)
QVQLQESGGGLVQAGGSLRVSCAASGRTLSNYAVGWWRQAPGKQREFVAAINWSSGGISYSNSAKGRFALSR

DNAKNTVYLQMDSLKPEDTAVYYCAAASSVLSGTVDYWGQGTQVTVSSAAAYPYDVPDYGSHHHHHH
or

3LEC 11
(SEQ ID NO: 1134)
QVQLQESGGGLVQPGGSLRLSCAASGSISSINAMGWYRQAPGKQRELVAAITGQGRTTYADSVKGRFTISRDG

AKNTVYLQMNSLKPEDTAVYYCKVFAADGMEYWGKGTQVTVSSAAAYPYDVPDYGSHHHHHH
or

3LEC 13
(SEQ ID NO: 1135)
QVQLQESGGGLVQPGGSLRLSCAASGRFFRVNAMGWYRQAPGKQRELVAAITNGGQIVYADSVKGRFTISRDS

AKNTVYLQMNSLKSEDTAVYYCNAKAAASYVSTVADYWGQGTQVTVSSAAAYPYDVPDYGSHHHHHH
or

3LEC 15
(SEQ ID NO: 1136)
QVQLQESGGGLVQAGGSLRLSCAASGSVFSINAMGWYRQAPEKQRELVAAITTQGRTTYEDSVKGRFTISRDG

AQNTVYLQMDSLKPEDTAVYYCKAWTAKDDYWGKGTQVTVSSAAAYPYDVPDYGSHHHHHH
or

3LEC 22
(SEQ ID NO: 1137)
QVQLQESGGGRVQPGGSLRLSCAAIGSIFEINSIGWYRQAPGKQRELVAAITSGGITNYANSVQGRSTISRDNVN

NTVYLQMNSLKPEDSAVYYCKGFTGWGKEDYWGQGTQVTVSSAAAYPYDVPDYGSHHHHHH
or

3LEC 23
(SEQ ID NO: 1138)
QVQLQESGGGLVQTGGSLRLSCAASGSIFNINSMGWYRQAPGKQRELVAAITVGGRLAYADSAKGRFTISKESA

RNTVHLQMSSLKPEDTAVYYCTIWAADYQQYWGQGTQVTVSSAAAYPYDVPDYGSHHHHHH
or

3LEC 27
(SEQ ID NO: 1139)
QVQLQESGGGLVQAGGSLRLSCAASVNIGTLNSMAWYREAPGKQRELVAGITGGGQITYANSVRGRFTVSRDIA

KSTAYLQMNTLKPEDTAVYYCAAYDRSATPYWGQGTQVTVSSAAAYPYDVPDYGSHHHHHH
or

3LEC 30
(SEQ ID NO: 1140)
QVQLQESGGGLVQTGGSLRLSCAASGSIFSINSMGWYRQAPGKQRELVAAITSQGRSTYADSAKGRFTISLGNA

RNTVNLQMSSLKTEDTAVYYCTIWARDRQQYWGQGTQVTVSSAAAYPYDVPDYGSHHHHHH
or

3LEC 36
(SEQ ID NO: 1141)
QVQLQESGGGLVQPGGSLRLSCAASGRIGSINSMGWYRQAPGKQREMVAAITNGGATVYADSVKGRFTISRDN

AGNTVDLHMNSLRPEDSAVYYCKAFTRGDDYWGQGTQVTVSSAAAYPYDVPDYGSHHHHHH
or

3LEC 55
(SEQ ID NO: 1142)
QVQLQESGGGLVQPGGSLKLSCAASGSIFSFNAMGWYRQAPGKQRELVAAITDGGRLTYADSAKNRFTISRENT

RNTVHLQMSSLKAEDTAVYYCTIWTKDRQQYWGQGTQVTVSSAAAYPYDVPDYGSHHHHHH
or

```
3LEC 57
                                                     (SEQ ID NO: 1143)
QVQLQESGGGLVQPGGSLRLSCAASGRISSINSMGWYRQAPGKQRELVAAITNGGAKTYADSVKGRFTISRDG

AGNTVYLQMDNLRPEDTAVYYCKAFTRTYDYWGQGTQVTVSSAAAYPYDVPDYGSHHHHHH
or

3LEC 61
                                                     (SEQ ID NO: 1144)
QVQLQESGGGLVQAGGSLRVSCAASGRTLSNYAVAWFRQAPGKQREFVAAINWSSGGISYSNAAKGRFALSR

DNAKNTVYLQMDSLKPEDTAVYYCAAASSILSGTVDYWGQGTQVTVSSAAAYPYDVPDYGSHHHHHH
or

3LEC 62
                                                     (SEQ ID NO: 1145)
QVQLQESGGGLVQPGGSLRLSCAASGRIGSINSMGWYRQAPGKQREMVAAITNGGATVYADSVKGRFTISRDN

AGNTVDLHMNSLRPEDSAVYYCTIWAADYQQYWGQGTQVTVSSAAAYPYDVPDYGSHHHHHH
or

3LEC 66
                                                     (SEQ ID NO: 1146)
QVQLQESGGGLVQPGGSLRLSCAASRSFFSFNAMGWYRQAPGKQRELVAAITNGGRIAYGTSVMGRFTISRDN

AKNTVYLQMDSLKPEDTAVYYCNAKPAPVYGSTVGDYWGQGTQVTVSSAAAYPYDVPDYGSHHHHHH
or

3LEC 69
                                                     (SEQ ID NO: 1147)
QVQLQESGGGLVQPGGSPRLSCAASGRFFRVNAMGWYRQAPGKQRELVAAITNGGQTAYADSVKGRFTISRD

SAKNTVYLQMNSLKSEDTAVYYCKVFAADGMEYWGKGTQVTVSSAAAYPYDVPDYGSHHHHHH
or

3LEC 76
                                                     (SEQ ID NO: 1148)
QVQLQESGGGLVQPGESLRLSCAASGIIFSINAMGWYRQAPGKQRELVAAITNXGRTTYADSVKGRFTISRDNAK

NTVTLQMNSLKPEDTAVYYCNAFGSGGGVGQGTQVTVSSAAAYPYDVPDYGSHHHHHH
or

3LEC 82
                                                     (SEQ ID NO: 1149)
QVQLQESGGGLVQAGGSLRLSCAASGRTLSNYAVAWFRQAPGKQRELVAAIWWASGGISYANSAKGRFVLSR

DNAKNTVYLQMDSLKPEDTAVYYCAAASSVLSGTADYWGQGTQVTVSSAAAYPYDVPDYGSHHHHHH
or

3LEC 89
                                                     (SEQ ID NO: 1150)
QVQLQESGGGLVQPGGSLRLSCAASGRIFSVNAMGWYRQAPGKQRELVAAITNQGAPTYADSVKGRFTISRDN

AGNTVYLQMNSLRPEDTAVYYCKAFTRGDDYWGQGTQVTVSSAAAYPYDVPDYGSHHHHHH
or

3LEC 94
                                                     (SEQ ID NO: 1151)
QVQLQESGGGSVQAGGSLRLSCAASGRTFSSYAMAWFRQAPGMERELVAAISWSGGSTYYADSVKGRFTISR

DNAENTVYLQMNSLKPEDTAVYYCAAEAEGSGREGNFYERSWYGQGTQVTVSSAAAYPYDVPDYGSHHHHHH.
```

In various illustrative embodiments, the Clec9A targeting moiety comprises an amino acid sequence selected from any one of the sequences provided above without the terminal histidine tag sequence (i.e., HHHHHH; SEQ ID NO: 327).

In some embodiments, the Clec9A targeting moiety comprises an amino acid sequence selected from SEQ ID Nos: 1086-1151 (provided above) without the HA tag (i.e., YPYDVPDYGS; SEQ ID NO:328).

In some embodiments, the Clec9A targeting moiety comprises an amino acid sequence selected from SEQ ID Nos: 1086-1151 (provided above) without the AAA linker (i.e., AAA).

In some embodiments, the Clec9A targeting moiety comprises an amino acid sequence selected from SEQ ID Nos: 1086-1151 (provided above) without the AAA linker, HA tag, and terminal histidine tag sequence (i.e., AAAYPYDVPDYGSHHHHHH; SEQ ID NO: 329).

In various illustrative embodiments, the Clec9A targeting moiety comprises an amino acid sequence selected from the following sequences:

```
R1CHCL50:
                                                     (SEQ ID NO: 1152)
QVQLVESGGGLVHPGGSLRLSCAASGSFSSINVMGWYRQAPGKERELVAR

ITNLGLPNYADSVTGRFTISRDNAKNTVYLQMNSLKPEDTAVYYCYLVAL

KAEYWGQGTQVTVSS;
```

-continued

R1CHCL50_opt1 (E1D-A74S-K83R-Q108L):
(SEQ ID NO: 1153)
DVQLVESGGGLVHPGGSLRLSCAASGSFSSINVMGWYRQAPGKERELVAR

ITNLGLPNYADSVTGRFTISRDNSKNTVYLQMNSLRPEDTAVYYCYLVAL

KAEYWGQGTLVTVSS;

R1CHCL50_opt2 (E1D-A74S-K83R-Q108L-H13Q):
(SEQ ID NO: 1154)
DVQLVESGGGLVQPGGSLRLSCAASGSFSSINVMGWYRQAPGKERELVAR

ITNLGLPNYADSVTGRFTISRDNSKNTVYLQMNSLRPEDTAVYYCYLVAL

KAEYWGQGTLVTVSS;

R1CHCL50_opt3 (E1D-A74S-K83R-Q108L-T64K):
(SEQ ID NO: 1155)
DVQLVESGGGLVHPGGSLRLSCAASGSFSSINVMGWYRQAPGKERELVAR

ITNLGLPNYADSVKGRFTISRDNSKNTVYLQMNSLRPEDTAVYYCYLVAL

KAEYWGQGTLVTVSS;

R1CHCL50_opt4 (E1D-A74S-K83R-Q108L-H13Q-T64K):
(SEQ ID NO: 1156)
DVQLVESGGGLVQPGGSLRLSCAASGSFSSINVMGWYRQAPGKERELVAR

ITNLGLPNYADSVKGRFTISRDNSKNTVYLQMNSLRPEDTAVYYCYLVAL

KAEYWGQGTLVTVSS;

3LEC_89:
(SEQ ID NO: 1157)
QVQLQESGGGLVQPGGSLRLSCAASGRIFSVNAMGWYRQAPGKQRELVAA

ITNQGAPTYADSVKGRFTISRDNAGNTVYLQMNSLRPEDTAVYYCKAFTR

GDDYWGQGTQVTVSS;

3LEC_89_opt1 (E1D-Q5V-Q108L):
(SEQ ID NO: 1158)
DVQLVESGGGLVQPGGSLRLSCAASGRIFSVNAMGWYRQAPGKQRELVAA

ITNQGAPTYADSVKGRFTISRDNAGNTVYLQMNSLRPEDTAVYYCKAFTR

GDDYWGQGTLVTVSS;

3LEC_89_opt2 (E1D-Q5V-Q108L-A74S):
(SEQ ID NO: 1159)
DVQLVESGGGLVQPGGSLRLSCAASGRIFSVNAMGWYRQAPGKQRELVAA

ITNQGAPTYADSVKGRFTISRDNSGNTVYLQMNSLRPEDTAVYYCKAFTR

GDDYWGQGTLVTVSS;

3LEC_89_opt3 (E1D-Q5V-Q108L-G75K):
(SEQ ID NO: 1160)
DVQLVESGGGLVQPGGSLRLSCAASGRIFSVNAMGWYRQAPGKQRELVAA

ITNQGAPTYADSVKGRFTISRDNAKNTVYLQMNSLRPEDTAVYYCKAFTR

GDDYWGQGTLVTVSS;
and

3LEC_89_opt4 (E1D-Q5V-Q108L-A74S-G75K):
(SEQ ID NO: 1161)
DVQLVESGGGLVQPGGSLRLSCAASGRIFSVNAMGWYRQAPGKQRELVAA

ITNQGAPTYADSVKGRFTISRDNSKNTVYLQMNSLRPEDTAVYYCKAFTR

GDDYWGQGTLVTVSS.

In an embodiment, the Clec9A targeting moiety comprises the anti-Clec9A antibody as disclosed in Tullett et al., JCI Insight. 2016; 1 (7):e87102, the entire disclosures of which are hereby incorporated by reference.

In various embodiments, the present invention contemplates the use of any natural or synthetic analogs, mutants, variants, alleles, homologs and orthologs (herein collectively referred to as "analogs") of the Clec9A targeting moiety of the invention as described herein. In various embodiments, the amino acid sequence of the Clec9A targeting moiety further includes an amino acid analog, an amino acid derivative, or other non-classical amino acids.

In various embodiments, the Clec9A targeting moiety comprises a sequence that is at least 60% identical to any one of the Clec9A sequences disclosed herein. For example, the Clec9A targeting moiety may comprise a targeting moiety comprising a sequence that is at least about 60%, at least about 61%, at least about 62%, at least about 63%, at least about 64%, at least about 65%, at least about 66%, at least about 67%, at least about 68%, at least about 69%, at least about 70%, at least about 71%, at least about 72%, at least about 73%, at least about 74%, at least about 75%, at least about 76%, at least about 77%, at least about 78%, at least about 79%, at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or 100% identical to any of the sequences disclosed herein (e.g. about 60%, or about 61%, or about 62%, or about 63%, or about 64%, or about 65%, or about 66%, or about 67%, or about 68%, or about 69%, or about 70%, or about 71%, or about 72%, or about 73%, or about 74%, or about 75%, or about 76%, or about 77%, or about 78%, or about 79%, or about 80%, or about 81%, or about 82%, or about 83%, or about 84%, or about 85%, or about 86%, or about 87%, or about 88%, or about 89%, or about 90%, or about 91%, or about 92%, or about 93%, or about 94%, or about 95%, or about 96%, or about 97%, or about 98%, about 99% or about 100% sequence identity to any one of the sequences disclosed herein).

In various embodiments, the Clec9A targeting moiety comprises an amino acid sequence having one or more amino acid mutations with respect to any one of the sequences disclosed herein. In various embodiments, the Clec9A targeting moiety comprises an amino acid sequence having one, or two, or three, or four, or five, or six, or seen, or eight, or nine, or ten, or fifteen, or twenty amino acid mutations with respect to any one of the sequences disclosed herein. In some embodiments, the one or more amino acid mutations may be independently selected from substitutions, insertions, deletions, and truncations.

In some embodiments, the amino acid mutations are amino acid substitutions, and may include conservative and/or non-conservative substitutions.

"Conservative substitutions" may be made, for instance, on the basis of similarity in polarity, charge, size, solubility, hydrophobicity, hydrophilicity, and/or the amphipathic nature of the amino acid residues involved. The 20 naturally occurring amino acids can be grouped into the following six standard amino acid groups: (1) hydrophobic: Met, Ala, Val, Leu, Ile; (2) neutral hydrophilic: Cys, Ser, Thr; Asn, Gln; (3) acidic: Asp, Glu; (4) basic: His, Lys, Arg; (5) residues that influence chain orientation: Gly, Pro; and (6) aromatic: Trp, Tyr, Phe.

As used herein, "conservative substitutions" are defined as exchanges of an amino acid by another amino acid listed within the same group of the six standard amino acid groups shown above. For example, the exchange of Asp by Glu retains one negative charge in the so modified polypeptide. In addition, glycine and proline may be substituted for one another based on their ability to disrupt α-helices.

As used herein, "non-conservative substitutions" are defined as exchanges of an amino acid by another amino acid listed in a different group of the six standard amino acid groups (1) to (6) shown above.

In various embodiments, the substitutions may also include non-classical amino acids. Illustrative non-classical amino acids include, but are not limited to, selenocysteine, pyrrolysine, N-formylmethionine β-alanine, GABA and δ-Aminolevulinic acid, 4-aminobenzoic acid (PABA), D-isomers of the common amino acids, 2,4-diaminobutyric acid, α-amino isobutyric acid, 4-aminobutyric acid, Abu, 2-amino butyric acid, γ-Abu, ε-Ahx, 6-amino hexanoic acid, Aib, 2-amino isobutyric acid, 3-amino propionic acid, ornithine, norleucine, norvaline, hydroxyproline, sarcosme, citrulline, homocitrulline, cysteic acid, t-butylglycine, t-butylalanine, phenylglycine, cyclohexylalanine, β-alanine, fluoro-amino acids, designer amino acids such as β methyl amino acids, C α-methyl amino acids, N α-methyl amino acids, and amino acid analogs in general.

In various embodiments, the amino acid mutation may be in the CDRs of the targeting moiety (e.g., the CDR1, CDR2 or CDR3 regions). In another embodiment, amino acid alteration may be in the framework regions (FRs) of the targeting moiety (e.g., the FR1, FR2, FR3, or FR4 regions).

Modification of the amino acid sequences may be achieved using any known technique in the art e.g., site-directed mutagenesis or PCR based mutagenesis. Such techniques are described, for example, in Sambrook et al., Molecular Cloning: A Laboratory Manual, Cold Spring Harbor Press, Plainview, N.Y., 1989 and Ausubel et al., Current Protocols in Molecular Biology, John Wiley & Sons, New York, N.Y., 1989.

In various embodiments, the mutations do not substantially reduce the Clec9A targeting moiety's capability to specifically bind to Clec9A. In various embodiments, the mutations do not substantially reduce the Clec9A targeting moiety's capability to specifically bind to Clec9A and without functionally modulating (e.g., partially or fully neutralizing) Clec9A.

In various embodiments, the binding affinity of the Clec9A targeting moiety of the invention for the full-length and/or mature forms and/or isoforms and/or splice variants and/or fragments and/or monomeric and/or dimeric forms and/or any other naturally occurring or synthetic analogs, variants, or mutants (including monomeric and/or dimeric forms) of human Clec9A may be described by the equilibrium dissociation constant ($K_D$). In various embodiments, the Clec9A targeting moiety binds to the full-length and/or mature forms and/or isoforms and/or splice variants and/or fragments and/or any other naturally occurring or synthetic analogs, variants, or mutants (including monomeric and/or dimeric forms) of human Clec9A with a $K_D$ of less than about 1 µM, about 900 nM, about 800 nM, about 700 nM, about 600 nM, about 500 nM, about 400 nM, about 300 nM, about 200 nM, about 100 nM, about 90 nM, about 80 nM, about 70 nM, about 60 nM, about 50 nM, about 40 nM, about 30 nM, about 20 nM, about 10 nM, or about 5 nM, or about 1 nM.

In various embodiments, the Clec9A targeting moiety binds but does not functionally modulate (e.g., partially or fully neutralize) the antigen of interest, i.e., Clec9A. For instance, in various embodiments, the Clec9A targeting moiety simply targets the antigen but does not substantially functionally modulate (e.g. partially or fully inhibit, reduce or neutralize) a biological effect that the antigen has. In various embodiments, the Clec9A targeting moiety binds an epitope that is physically separate from an antigen site that is important for its biological activity (e.g. an antigen's active site).

Such binding without significant function modulation finds use in various embodiments of the present invention, including methods in which the Clec9A targeting moiety is used to directly or indirectly recruit active immune cells to a site of need via an effector antigen. For example, in various embodiments, the Clec9A targeting moiety may be used to directly or indirectly recruit dendritic cells via Clec9A to a tumor cell in a method of reducing or eliminating a tumor (e.g., the Clec9A targeting moiety may comprise an anti-Clec9A antigen recognition domain and a targeting moiety having a recognition domain (e.g. antigen recognition domain) directed against a tumor antigen or receptor).

In such embodiments, it is desirable to directly or indirectly recruit dendritic cells but not to functionally modulate or neutralize the Clec9A activity. In these embodiments, Clec9A signaling is an important piece of the tumor reducing or eliminating effect.

In some embodiments, the Clec9A targeting moiety enhances antigen-presentation by dendritic cells. For example, in various embodiments, the Clec9A targeting moiety directly or indirectly recruits dendritic cells via Clec9A to a tumor cell, where tumor antigens are subsequently endocytosed and presented on the dendritic cell for induction of potent humoral and cytotoxic T cell responses.

In other embodiments (for example, related to treating autoimmune or neurodegenerative disease), the Clec9A targeting moiety binds and neutralizes the antigen of interest, i.e., Clec9A. For instance, in various embodiments, the present methods may inhibit or reduce Clec9A signaling or expression, e.g. to cause a reduction in an immune response.

In various embodiments, the present multi-specific chimeric protein or chimeric protein complex has one or more targeting moieties directed against SIRP1α. In some embodiments, the SIRP1α targeting moiety comprises a recognition domain that recognizes one or more epitopes present on human SIRP1α. In an embodiment, the SIRP1α targeting moiety comprises a recognition domain that recognizes human SIRP1α with a signal peptide sequence. An illustrative human SIRP1α polypeptide with a signal peptide sequence is provided below:

```
                                          (SEQ ID NO: 1)
MEPAGPAPGRLGPLLCLLLAASCAWSGVAGEEELQVIQPDKSVLVAAGET

ATLRCTATSLIPVGPIQWFRGAGPGRELIYNQKEGHFPRVTTVSDLTKRN

NMDFSIRIGNITPADAGTYYCVKFRKGSPDDVEFKSGAGTELSVRAKPSA

PVVSGPAARATPQHTVSFTCESHGFSPRDITLKWFKNGNELSDFQTNVDP

VGESVSYSIHSTAKVVLTREDVHSQVICEVAHVTLQGDPLRGTANLSETI

RVPPTLEVTQQPVRAENQVNVTCQVRKFYPQRLQLTWLENGNVSRTETAS

TVTENKDGTYNWMSWLLVNVSAHRDDVKLTCQVEHDGQPAVSKSHDLKVS

AHPKEQGSNTAAENTGSNERNIYIWGVVCTLLVALLMAALYLVRIRQKKA

QGSTSSTRLHEPEKNAREITQDTNDITYADLNLPKGKKPAPQAAEPNNHT

EYASIQTSPQPASEDTLTYADLDMVHLNRTPKQPAPKPEPSFSEYASVQV

PRK
```

In an embodiment, the SIRP1α targeting moiety comprises a recognition domain that recognizes human SIRP1α without a signal peptide sequence. An illustrative human SIRP1α polypeptide without a signal peptide sequence is provided below:

(SEQ ID NO: 2)
EEELQVIQPDKSVLVAAGETATLRCTATSLIPVGPIQWFRGAGPGRELIY

NQKEGHFPRVTTVSDLTKRNNMDFSIRIGNITPADAGTYYCVKFRKGSPD

VEFKSGAGTELSVRAKPSAPWSGPAARATPQHTVSFTCESHGFSPRDITL

KWFKNGNELSDFQTNVDPVGESVSYSIHSTAKWLTREDVHSQVICEVAHV

TLQGDPLRGTANLSETIRVPPTLEVTQQPVRAENQVNVTCQVRKFYPQRL

QLTWLENGNVSRTETASTVTENKDGTYNWMSWLLVNVSAHRDDVKLTCQV

EHDGQPAVSKSHDLKVSAHPKEQGSNTAAENTGSNERNIYIVVGWCTLLV

ALLMAALYLVRIRQKKAQGSTSSTRLHEPEKNAREITQDTNDITYADLNL

PKGKKPAPQAAEPNNHTEYASIQTSPQPASEDTLTYADLDMVHLNRTPKQ

PAPKPEPSFSEYASVQVPRK

In an embodiment, the SIRP1α targeting moiety comprises a recognition domain that recognizes a polypeptide encoding human SIRP1α isoform 2:

(SEQ ID NO: 3)
MEPAGPAPGRLGPLLCLLLAASCAWSGVAGEEELQVIQPDKSVLVAAGET

ATLRCTATSLIPVGPIQWFRGAGPGRELIYNQKEGHFPRVTTVSDLTKRN

NMDFSIRIGNITPADAGTYYCVKFRKGSPDDVEFKSGAGTELSVRAKPSA

PWSGPAARATPQHTVSFTCESHGFSPRDITLKWFKNGNELSDFQTNVDPV

GESVSYSIHSTAKVVLTREDVHSQVICEVAHVTLQGDPLRGTANLSETIR

VPPTLEVTQQPVRAENQVNVTCQVRKFYPQRLQLTWLENGNVSRTETAST

VTENKDGTYNWMSWLLVNVSAHRDDVKLTCQVEHDGQPAVSKSHDLKVSA

HPKEQGSNTAAENTGSNERNIYIVVGVVCTLLVALLMAALYLVRIRQKKA

QGSTSSTRLHEPEKNAREITQVQSLDTNDITYADLNLPKGKKPAPQAAEP

NNHTEYASIQTSPQPASEDTLTYADLDMVHLNRTPKQPAPKPEPSFSEYA

SVQVPRK

In an embodiment, the SIRP1α targeting moiety comprises a recognition domain that recognizes a polypeptide encoding human SIRP1α isoform 4:

(SEQ ID NO: 4)
MEPAGPAPGRLGPLLCLLLAASCAWSGVAGEEELQVIQPDKSVLVAAGET

ATLRCTATSLIPVGPIQWFRGAGPGRELIYNQKEGHFPRVTTVSDLTKRN

NMDFSIRIGNITPADAGTYYCVKFRKGSPDVEFKSGAGTELSVRAKPSAP

WSGPAARATPQHTVSFTCESHGFSPRDITLKWFKNGNELSDFQTNVDPVG

ESVSYSIHSTAKVVLTREDVHSQVICEVAHVTLQGDPLRGTANLSETIRV

PPTLEVTQQPVRAENQVNVTCQVRKFYPQRLQLTWLENGNVSRTETASTV

TENKDGTYNWMSWLLVNVSAHRDDVKLTCQVEHDGQPAVSKSHDLKVSAH

PKEQGSNTAAENTGSNERNIYIVVGVVCTLLVALLMAALYLVRIRQKKAQ

-continued

GSTSSTRLHEPEKNAREITQDTNDITYADLNLPKGKKPAPQAAEPNNHTE

YASIQTSPQPASEDTLTYADLDMVHLNRTPKQPAPKPEPSFSEYASVQVP

RK

In various embodiments, the SIRP1α targeting moieties of the present invention may be any protein-based agent capable of specific binding, such as an antibody or derivatives thereof. In an embodiment, the targeting moiety comprises an antibody. In various embodiments, the antibody is a full-length multimeric protein that includes two heavy chains and two light chains. Each heavy chain includes one variable region (e.g., $V_H$) and at least three constant regions (e.g., $CH_1$, $CH_2$ and $CH_3$), and each light chain includes one variable region ($V_L$) and one constant region ($C_L$). The variable regions determine the specificity of the antibody. Each variable region comprises three hypervariable regions also known as complementarity determining regions (CDRs) flanked by four relatively conserved framework regions (FRs). The three CDRs, referred to as CDR1, CDR2, and CDR3, contribute to the antibody binding specificity. In some embodiments, the antibody is a chimeric antibody. In some embodiments, the antibody is a humanized antibody.

In some embodiments, the SIRP1α targeting moiety comprises antibody derivatives or formats. In some embodiments, the SIRP1α targeting moiety is a single-domain antibody, a recombinant heavy-chain-only antibody (VHH), a single-chain antibody (scFv), a shark heavy-chain-only antibody (VNAR), a microprotein (cysteine knot protein, knottin), a DARPin; a Tetranectin; an Affibody; a Transbody; an Anticalin; an AdNectin; an Affilin; a Microbody; a peptide aptamer; an alterase; a plastic antibodies; a phylomer; a stradobody; a maxibody; an evibody; a fynomer, an armadillo repeat protein, a Kunitz domain, an avimer, an atrimer, a probody, an immunobody, a triomab, a troybody; a pepbody; a vaccibody, a UniBody; Affimers, a DuoBody, a Fv, a Fab, a Fab', a F(ab')$_2$, a peptide mimetic molecule, or a synthetic molecule, as described in U.S. Pat. Nos. or Patent Publication Nos. U.S. Pat. No. 7,417,130, US 2004/132094, U.S. Pat. No. 5,831,012, US 2004/023334, U.S. Pat. Nos. 7,250,297, 6,818,418, US 2004/209243, U.S. Pat. Nos. 7,838,629, 7,186,524, 6,004,746, 5,475,096, US 2004/146938, US 2004/157209, U.S. Pat. Nos. 6,994,982, 6,794,144, US 2010/239633, U.S. Pat. No. 7,803,907, US 2010/119446, and/or U.S. Pat. No. 7,166,697, the contents of which are hereby incorporated by reference in their entireties. See also, Storz MAbs. 2011 May-June; 3(3): 310-317.

In one embodiment, the SIRP1α targeting moiety comprises a single-domain antibody, such as VHH from, for example, an organism that produces VHH antibody such as a camelid, a shark, or a designed VHH. VHHs are antibody-derived therapeutic proteins that contain the unique structural and functional properties of naturally-occurring heavy-chain antibodies. VHH technology is based on fully functional antibodies from camelids that lack light chains. These heavy-chain antibodies contain a single variable domain (VHH) and two constant domains (CH2 and CH3).

In an embodiment, the SIRP1α targeting moiety comprises a VHH. In some embodiments, the VHH is a humanized VHH or camelized VHH.

In some embodiments, the VHH comprises a fully human $V_H$ domain, e.g. a HUMABODY (Crescendo Biologics, Cambridge, UK). In some embodiments, fully human $V_H$ domain, e.g. a HUMABODY is monovalent, bivalent, or trivalent. In some embodiments, the fully human $V_H$ domain, e.g. a HUMABODY is mono- or multi-specific such as monospecific, bispecific, or trispecific. Illustrative fully human V<sub>H</sub> domains, e.g. a HUMABODIES are described in, for example, WO 2016/113555 and WO2016/113557, the entire disclosure of which is incorporated by reference.

For example, in some embodiments, the SIRP1α targeting moiety of the present invention comprises one or more antibodies, antibody derivatives or formats, peptides or polypeptides, VHHs, or fusion proteins that selectively bind SIRP1α. In some embodiments, the SIRP1α targeting moiety is an antibody or derivative thereof that specifically binds to SIRP1α. In some embodiments, the chimeric protein or chimeric protein complex comprises a targeting moiety which is a camelid heavy chain antibody (VHH) that specifically binds to SIRP1α.

In some embodiments, the chimeric protein or chimeric protein complex comprises a targeting moiety that is a VHH comprising a single amino acid chain having four "framework regions" or FRs and three "complementary determining regions" or CDRs. As used herein, "framework region" or "FR" refers to a region in the variable domain which is located between the CDRs. As used herein, "complementary determining region" or "CDR" refers to variable regions in VHHs that contains the amino acid sequences capable of specifically binding to antigenic targets. In various embodiments, the present chimeric protein or chimeric protein complex comprises a VHH having a variable domain comprising at least one CDR1, CDR2, and/or CDR3 sequences.

In various embodiments, the targeting moieties of the invention may comprise any combination of heavy chain, light chain, heavy chain variable region, light chain variable region, complementarity determining region (CDR), and framework region sequences that is known to recognize and bind to SIRP1α.

In various embodiments, the SIRP1α targeting moiety comprises a VHH having a variable domain comprising at least one CDR1, CDR2, and/or CDR3 sequences. In various embodiments, the SIRP1α targeting moiety comprises a VHH having a variable region comprising at least one FR1, FR2, FR3, and FR4 sequences.

In some embodiments, a human SIRP1α CDR1 sequence is selected from: GRTFSSLDMG (SEQ ID NO: 277), SLDMG (SEQ ID NO: 278), GFTFGGYDMG (SEQ ID NO: 279), GYDMG (SEQ ID NO: 280), GRTSSSLDMG (SEQ ID NO: 281), GHTFSSLDMG (SEQ ID NO: 282), ERTFSSLDMG (SEQ ID NO: 283), GRAFSSLDMG (SEQ ID NO: 284), GLNFRRYTMG (SEQ ID NO: 285), and RYTMG (SEQ ID NO: 286).

In some embodiments, a human SIRP1α CDR2 sequence is selected from: GISRSGISQY (SEQ ID NO: 287), GISRSGISQYYADSMKG (SEQ ID NO: 288), GISRSGISQYYADSMRG (SEQ ID NO: 289), GISRTGISAY (SEQ ID NO: 290), GISRTGISAYYADSMKG (SEQ ID NO: 291), GISRSGISQYYANSMKG (SEQ ID NO: 292), GVSRSGISQY (SEQ ID NO: 293), GVSRSGISQYYADSMKG (SEQ ID NO: 294), VINWSDDSIY (SEQ ID NO: 295), and VINWSDDSIYYADSVKG (SEQ ID NO: 296).

In some embodiments, a human SIRP1α CDR3 sequence is selected from: ALTFRGSDLPRDSNY (SEQ ID NO: 297), ALTFRGSNLPRDSNY (SEQ ID NO: 298), and SPQWDTRVRQTMRGKYDY (SEQ ID NO: 299).

In various illustrative embodiments, a human SIRP1α targeting moiety comprises an amino acid sequence selected from the following sequences:

2HSI1:
(SEQ ID NO: 300)
QVQLQESGGGWQAGDSLRLSCVASGRTFSSLDMGWFRQAPGKEREFVAGI
SRSGISQYYADSMKGRFTISRDNAKNLVYLQMNSLKPEDTAVYYCAAALT
FRGSDLPRDSNYWGQGTQVTVSSAAAYPYDVPDYGSHHHHHH;

2HSI3:
(SEQ ID NO: 301)
QVQLQESGGGWQAGDSLKLSCVASGRTFSSLDMGWFRQAPGKEREFVAGI
SRSGISQYYADSMKGRFTISRDNAKNLVYLQMNSLKPEDTAVYYCAAALT
FRGSDLPRDSNYWGQGTQVTVSSAAAYPYDVPDYGSHHHHHH;

2HSI24:
(SEQ ID NO: 302)
QVQLQESGGGWQAGDSLRLSCVASGRTFSSLDMGWFRQTPGKEREFVAGI
SRSGISQYYADSMKGRFTISRDNAKNLVYLQMNSLKPEDTAVYYCAAALT
FRGSDLPRDSNYWGQGTQVTVSSAAAYPYDVPDYGSHHHHHH;

2HSI27:
(SEQ ID NO: 303)
QVQLQESGGGLVQPGDSLRLSCVASGRTFSSLDMGWFRQAPGKERXFVAG
ISRSGISQYYADSMKGRFTISRDNAKNLVYLQMNSLKPEDTAVYYCAAAL
TFRGSDLPRDSNYWGQGTQVTVSSAAAYPYDVPDYGSHHHHHH;

2HSI31:
(SEQ ID NO: 304)
QVQLQESGGGWQAGDSLRLSCVASGRTFSSLDMGWFRQAPGKEREFVAGI
SRSGISQYYADSMRGRFTISRDNAKNLVYLQMNSLKPEDTAVYYCAAALT
FRGSDLPRDSNYWGQGTQVTVSSAAAYPYDVPDYGSHHHHHH;

2HSI32:
(SEQ ID NO: 305)
QVQLQESGGGWQAGDSLRLSCVASGRTFSSLDMGWFRQAPGKEREFVAGI
SRTGISAYYADSMKGRFTISRDNAKNLVYLQMNSLKSEDTAVYYCAAALT
FRGSDLPRDSNYWGQGTQVTVSSAAAYPYDVPDYGSHHHHHH;

2HSI35:
(SEQ ID NO: 306)
QVQLQESGGGLVQPGGSLRLSCAASGFTFGGYDMGWFRQAPGKEREFVAG
ISRSGISQYYADSMKGRFTISRDNAKNLVYLQMNSLKPEDTAVYYCAAAL
TFRGSDLPRDSNYWGQGTQVTVSSAAAYPYDVPDYGSHHHHHH;

2HSI40:
(SEQ ID NO: 307)
QVQLQESGGGWQAGDSLRLSCVASGRTFSSLDMGWFRQAPGKEREFVAGI
SRSGISQYYADSMKGRFTISRDNAKSLVYLQMNSLKPEDTAVYYCAAALT
FRGSDLPRDSNYWGQGTQVTVSSAAAYPYDVPDYGSHHHHHH;

2HSI44:
(SEQ ID NO: 308)
QVQLQESGGGLVQAGGSLRLSCTASGRTFSSLDMGWFRQAPGKEREFVAG
ISRSGISQYYADSMKGRFTISRDNAKNLVYLQMNSLKPEDTAVYYCAAAL
TFRGSDLPRDSNYWGQGTQVTVSSAAAYPYDVPDYGSHHHHHH;

2HSI49:
(SEQ ID NO: 309)
QVQLQESGGGVVQTGDSLRLSCVASGRTFSSLDMGWFRQAPGKEREFVAG
ISRSGISQYYADSMKGRFTISRDNAKNLVYLQMNSLKPEDTAVYYCAAAL
TFRGSDLPRDSNYWGQGTQVTVSSAAAYPYDVPDYGSHHHHHH;

2HSI54:
(SEQ ID NO: 310)
QVQLQESGGGVVQAGDSLRLSCVASGRTFSSLDMGWFRQAPGKEREFVAG

ISRSGISQYYANSMKGRFTISRDNAKNLVYLQMNSLKPEDTAVYYCAAAL

TFRGSDLPRDSNYWGQGTQVTVSSAAAYPYDVPDYGSHHHHHH;

2HSI55:
(SEQ ID NO: 311)
QVQLQESGGGVVQAGDPLRLSCVASGRTFSSLDMGWFRQAPGKEREFVAG

ISRSGISQYYADSMKGRFTISRDNAKNLVYLQMNSLKPEDTAVYYCAAAL

TFRGSDLPRDSNYWGQGTQVTVSSAAAYPYDVPDYGSHHHHHH;

2HSI57:
(SEQ ID NO: 312)
QVQLQESGGGLVQAGGSLRLSCAASGRTFSSLDMGWFRQAPGKEREFVAG

ISRSGISQYYADSMKGRFTISRDNAKNLVYLQMNSLKPEDTAVYYCAAAL

TFRGSDLPRDSNYWGQGTQVTVSSAAAYPYDVPDYGSHHHHHH;

2HSI68:
(SEQ ID NO: 313)
QVQLQESGGGWVQPGGSLRLSCEASGRTSSSLDMGWFRQAPGKEREFVAG

ISRTGISAYYADSMKGRFTISRDNAKNLVYLQMNSLKSEDTAVYYCAAAL

TFRGSDLPRDSNYWGQGTQVTVSSAAAYPYDVPDYGSHHHHHH;

2HSI77:
(SEQ ID NO: 314)
QVQLQESGGGSVQAGGSLRLSCVASGRTFSSLDMGWFRQAPGKEREFVAG

ISRSGISQYYADSMKGRFTISRDNAKNLVYLQMNSLKPEDTAVYYCAAAL

TFRGSDLPRDSNYWGQGTQVTVSSAAAYPYDVPDYGSHHHHHH;

2HSI80:
(SEQ ID NO: 315)
QVQLQESGGGVVQAGDSLRLSCVASGRTFSSLDMGWFRQAPGKEREFVAG

VSRSGISQYYADSMKGRFTISRDNAKNLVYLQMNSLKPEDTAVYYCAAAL

TFRGSDLPRDSNYWGQGTQVTVSSAAAYPYDVPDYGSHHHHHH;

2HSI86:
(SEQ ID NO: 316)
QVQLQESGGGLVQPGGSLRLSCAASGRTFSSLDMGWFRQAPGKEREFVAG

ISRSGISQYYADSMKGRFTISRDNAKNLVYLQINSLKPEDTAVYYCAAAL

TFRGSDLPRDSNYWGQGTQVTVSSAAAYPYDVPDYGSHHHHHH;

2HSI88:
(SEQ ID NO: 317)
QVQLQESGGGWQAGDSLRLSCVASGHTFSSLDMGWFRQAPGKEREFVAGI

SRSGISQYYADSMKGRFTISRDNAKNLVYLQMNSLKPEDTAVYYCAAALT

FRGSDLPRDSNYWGQGTQVTVSSAAAYPYDVPDYGSHHHHHH;

2HSI89:
(SEQ ID NO: 318)
QVQLQESGGGWQAGDSLRLSCVASERTFSSLDMGWFRQAPGKEREFVAGI

SRSGISQYYADSMKGRFTISRDNAKNLVYLQMNSLKPEDTAVYYCAAALT

FRGSNLPRDSNYWGQGTQVTVSSAAAYPYDVPDYGSHHHHHH;

2HSI90:
(SEQ ID NO: 319)
QVQLQESGGGWQAGDSLRLSCVASERTFSSLDMGWFRQAPGKEREFVAGI

SRSGISQYYADSMKGRFTISRDNAKNLVYLQMNSLKPEDTAVYYCAAALT

FRGSDLPRDSNYWGQGTQVTVSSAAAYPYDVPDYGSHHHHHH;

2HSI98:
(SEQ ID NO: 320)
QVQLQESGGGWQAGDSLGLSCVASGRTFSSLDMGWFRQAPGKEREFVAGI

SRSGISQYYADSMKGRFTISRDNAKNLVYLQMNSLKPEDTAVYYCAAALT

FRGSDLPRDSNYWGQGTQVTVSSAAAYPYDVPDYGSHHHHHH;

2HSI102:
(SEQ ID NO: 321)
QVQLQESGGGWQAGDSLRLSCVASGRAFSSLDMGWFRQAPGKEREFVAGI

SRSGISQYYADSMKGRFTISRDNAKNLVYLQMNSLKPEDTAVYYCAAALT

FRGSDLPRDSNYWGQGTQVTVSSAAAYPYDVPDYGSHHHHHH;

2HSI105:
(SEQ ID NO: 322)
QVQLQESGGGWQAGDSLRLSCVASGRTFSSLDMGWFRQAPGKEREFVAGI

SRSGISQYYADSMKGRFTISRDNAKNLVYLQMNSLRPEDTAVYYCAAALT

FRGSDLPRDSNYWGQGTQVTVSSAAAYPYDVPDYGSHHHHHH;

2HSI109:
(SEQ ID NO: 323)
QVQLQESGGGSVQAGDSLRLSCVASGRTFSSLDMGWFRQAPGKEREFVAG

ISRTGISAYYADSMKGRFTISRDNAKNLVYLQMNSLKSEDTAVYYCAAAL

TFRGSDLPRDSNYWGQGTQVTVSSAAAYPYDVPDYGSHHHHHH;

2HSI110:
(SEQ ID NO: 324)
QVQLQESGGGLVQSGDSLRLSCVASGRTFSSLDMGWFRQAPGKEREFVAG

ISRSGISQYYADSMKGRFTISRDNAKNLVYLQMNSLKPEDTAVYYCAAAL

TFRGSDLPRDSNYWGQGTQVTVSSAAAYPYDVPDYGSHHHHHH;

2HSI113:
(SEQ ID NO: 325)
QVQLQESGGGLVQAGDSLRLSCVASGRTFSSLDMGWFRQAPGKEREFVAG

ISRSGISQYYADSMKGRFTISRDNAKNLVYLQMNSLKPEDTAVYYCAAAL

TFRGSDLPRDSNYWGQGTQVTVSSAAAYPYDVPDYGSHHHHHH;
and

2HSI22:
(SEQ ID NO: 326)
QVQLQESGGGLVQPGGSLRLSCAASGLNFRRYTMGWFRQAPGKEREFVGV

INWSDDSIYYADSVKGRFAISRDNTKNTVYLQMASLKPEDTAVYYCAASP

QWDTRVRQTMRGKYDYWGQGTQVTVSSAAAYPYDVPDYGSHHHHHH.

In various illustrative embodiments, the SIRP1α targeting moiety comprises an amino acid sequence selected from SEQ ID NO: 300 to SEQ ID NO: 326 without the terminal histidine tag sequence (i.e., HHHHHH; SEQ ID NO: 327).

In some embodiments, the SIRP1α targeting moiety comprises an amino acid sequence selected from SEQ ID Nos: 300 to SEQ ID NO: 326 (provided above) without the HA tag (i.e., YPYDVPDYGS; SEQ ID NO: 328).

In some embodiments, the SIRP1α targeting moiety comprises an amino acid sequence selected from SEQ ID Nos: 300 to SEQ ID NO: 326 (provided above) without the AAA linker.

In some embodiments, the SIRP1α targeting moiety comprises an amino acid sequence selected from SEQ ID Nos: 300 to SEQ ID NO: 326 (provided above) without the AAA linker, HA tag, and terminal histidine tag sequence (i.e., AAAYPYDVPDYGSHHHHHH; SEQ ID NO: 329).

In various embodiments, the present technology contemplates the use of any natural or synthetic analogs, mutants, variants, alleles, homologs and orthologs (herein collectively referred to as "analogs") of the SIRP1α targeting moiety described herein. In various embodiments, the amino acid sequence of the SIRP1α targeting moiety further includes an amino acid analog, an amino acid derivative, or other non-classical amino acids.

In various embodiments, the SIRP1α targeting moiety comprises a sequence that is at least 60% identical to any one of the SIRP1α sequences disclosed herein. For example, the SIRP1α targeting moiety may comprise a sequence that is at least about 60%, at least about 61%, at least about 62%, at least about 63%, at least about 64%, at least about 65%, at least about 66%, at least about 67%, at least about 68%, at least about 69%, at least about 70%, at least about 71%, at least about 72%, at least about 73%, at least about 74%, at least about 75%, at least about 76%, at least about 77%, at least about 78%, at least about 79%, at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or 100% identical to any of the SIRP1α sequences disclosed herein (e.g., about 60%, or about 61%, or about 62%, or about 63%, or about 64%, or about 65%, or about 66%, or about 67%, or about 68%, or about 69%, or about 70%, or about 71%, or about 72%, or about 73%, or about 74%, or about 75%, or about 76%, or about 77%, or about 78%, or about 79%, or about 80%, or about 81%, or about 82%, or about 83%, or about 84%, or about 85%, or about 86%, or about 87%, or about 88%, or about 89%, or about 90%, or about 91%, or about 92%, or about 93%, or about 94%, or about 95%, or about 96%, or about 97%, or about 98%, about 99% or about 100% sequence identity to any one of the SIRP1α sequences disclosed herein).

In various embodiments, the SIRP1α targeting moiety comprising an amino acid sequence having one or more amino acid mutations with respect to any targeting moiety sequence that is known to recognize and bind to SIRP1α. In various embodiments, the SIRP1α targeting moiety comprises an amino acid sequence having one, or two, or three, or four, or five, or six, or seen, or eight, or nine, or ten, or fifteen, twenty, thirty, forty, or fifty amino acid mutations with respect to any targeting moiety sequence that is known to recognize and bind to SIRP1α. In some embodiments, the one or more amino acid mutations may be independently selected from substitutions, insertions, deletions, and truncations.

In some embodiments, the amino acid mutations are amino acid substitutions, and may include conservative and/or non-conservative substitutions.

"Conservative substitutions" may be made, for instance, on the basis of similarity in polarity, charge, size, solubility, hydrophobicity, hydrophilicity, and/or the amphipathic nature of the amino acid residues involved. The 20 naturally occurring amino acids can be grouped into the following six standard amino acid groups: (1) hydrophobic: Met, Ala, Val, Leu, Ile; (2) neutral hydrophilic: Cys, Ser, Thr; Asn, Gln; (3) acidic: Asp, Glu; (4) basic: His, Lys, Arg; (5) residues that influence chain orientation: Gly, Pro; and (6) aromatic: Trp, Tyr, Phe.

As used herein, "conservative substitutions" are defined as exchanges of an amino acid by another amino acid listed within the same group of the six standard amino acid groups shown above. For example, the exchange of Asp by Glu retains one negative charge in the so modified polypeptide. In addition, glycine and proline may be substituted for one another based on their ability to disrupt α-helices.

As used herein, "non-conservative substitutions" are defined as exchanges of an amino acid by another amino acid listed in a different group of the six standard amino acid groups (1) to (6) shown above.

In various embodiments, the substitutions may also include non-classical amino acids. Illustrative non-classical amino acids include, but are not limited to, selenocysteine, pyrrolysine, N-formylmethionine β-alanine, GABA and δ-Aminolevulinic acid, 4-aminobenzoic acid (PABA), D-isomers of the common amino acids, 2,4-diaminobutyric acid, α-amino isobutyric acid, 4-aminobutyric acid, Abu, 2-amino butyric acid, γ-Abu, ε-Ahx, 6-amino hexanoic acid, Aib, 2-amino isobutyric acid, 3-amino propionic acid, ornithine, norleucine, norvaline, hydroxyproline, sarcosme, citrulline, homocitrulline, cysteic acid, t-butylglycine, t-butylalanine, phenylglycine, cyclohexylalanine, β-alanine, fluoro-amino acids, designer amino acids such as β methyl amino acids, C α-methyl amino acids, N α-methyl amino acids, and amino acid analogs in general.

In various embodiments, the amino acid mutation may be in the CDRs of the targeting moiety (e.g., the CDR1, CDR2 or CDR3 regions). In another embodiment, amino acid alteration may be in the framework regions (FRs) of the targeting moiety (e.g., the FR1, FR2, FR3, or FR4 regions).

Modification of the amino acid sequences may be achieved using any known technique in the art e.g., site-directed mutagenesis or PCR based mutagenesis. Such techniques are described, for example, in Sambrook et al., Molecular Cloning: A Laboratory Manual, Cold Spring Harbor Press, Plainview, N.Y., 1989 and Ausubel et al., Current Protocols in Molecular Biology, John Wiley & Sons, New York, N.Y., 1989.

In various embodiments, the mutations do not substantially reduce the SIRP1α's capability to specifically recognize and bind to SIRP1α. In various embodiments, the mutations do not substantially reduce the SIRP1α's capability to specifically bind to SIRP1α and without functionally modulating (e.g., partially or fully neutralizing) SIRP1α.

In various embodiments, the binding affinity of the SIRP1α targeting moiety for the full-length and/or mature forms and/or isoforms and/or splice variants and/or fragments and/or monomeric and/or dimeric forms and/or any other naturally occurring or synthetic analogs, variants, or mutants of SIRP1α may be described by the equilibrium dissociation constant ($K_D$). In various embodiments, the present SIRP1α targeting moiety comprises a targeting moiety that binds to the full-length and/or mature forms and/or isoforms and/or splice variants and/or fragments and/or any other naturally occurring or synthetic analogs, variants, or mutants (including monomeric and/or dimeric forms) of SIRP1α with a $K_D$ of less than about 1 μM, about 900 nM, about 800 nM, about 700 nM, about 600 nM, about 500 nM, about 400 nM, about 300 nM, about 200 nM, about 100 nM, about 90 nM, about 80 nM, about 70 nM, about 60 nM, about 50 nM, about 40 nM, about 30 nM, about 20 nM, about 10 nM, or about 5 nM, or about 1 nM.

In various embodiments, the SIRP1α targeting moiety binds but does not functionally modulate the antigen of interest, i.e., SIRP1α. For instance, in various embodiments, the SIRP1α targeting moiety simply targets the antigen but does not substantially functionally modulate (e.g. substantially inhibit, reduce or neutralize) a biological effect that the antigen has. In various embodiments, the SIRP1α targeting moiety binds an epitope that is physically separate from an antigen site that is important for its biological activity (e.g. an antigen's active site).

In other embodiments, the SIRP1α targeting moiety binds but functionally modulates the antigen of interest, i.e., SIRP1α. For instance, in various embodiments, the SIRP1α targeting moiety targets the antigen, i.e., SIRP1α, and functionally modulates (e.g. inhibit, reduce or neutralize) a biological effect that the antigen has. Such binding along with functional modulation may find use in various embodiments of the present invention including methods in which the present chimeric protein or chimeric protein complex is used to directly or indirectly recruit active immune cells to a site of need via an effector antigen.

For example, in various embodiments, the present SIRP1α targeting moiety may be used to directly or indirectly recruit macrophages via SIRP1α to a tumor cell in a method of reducing or eliminating a tumor (e.g. the present chimeric protein or chimeric protein complex may comprise a targeting moiety having an anti-SIRP1α antigen recognition domain and a targeting moiety having a recognition domain (e.g. antigen recognition domain) directed against a tumor antigen or receptor). Evidence indicates that tumor cells frequently upregulate CD47 which engages SIRP1α so as to evade phagocytosis. Accordingly, in various embodiments, it may be desirable to directly or indirectly recruit macrophages to tumor cells and functionally inhibit, reduce, or neutralize the inhibitory activity of SIRP1α thereby resulting in phagocytosis of the tumor cells by the macrophages. In various embodiments, the SIRP1α targeting moiety enhances phagocytosis of tumor cells or any other undesirable cells by macrophages.

In some embodiments, the targeting moiety is a natural ligand such as a chemokine. Illustrative chemokines that may be included in the chimeric protein or chimeric protein complex of the invention include, but are not limited to, CCL1, CCL2, CCL4, CCL5, CCL6, CCL7, CCL8, CCL9, CCL10, CCL11, CCL12, CCL13, CCL14, CCL15, CCL16, CL17, CCL18, CCL19, CCL20, CCL21, CCL22, CCL23, CCL24, CLL25, CCL26, CCL27, CXCL1, CXCL2, CXCL3, CXCL4, CXCL5, CXCL6, CXCL7, CXCL8, CXCL9, CXCL10, CXCL11, CXCL12, CXCL13, CXCL14, CXCL15, CXCL16, CXCL17, XCL1, XCL2, CX3CL1, HCC-4, and LDGF-PBP. In an illustrative embodiment, the targeting moiety may be XCL1 which is a chemokine that recognizes and binds to the dendritic cell receptor XCR1. For example, in some embodiments, the targeting moiety is an XCR1 binding agent, for example an antibody or antibody format directed against XCR1, the ligand XCL1, or the ligand XCL2.

An illustrative human XCL1 polypeptide is provided below:

(SEQ ID NO: 1456)
MRLLILALLGICSLTAYIVEGVGSEVSDKRTCVSLTTQRLPVSRIKTYTI

TEGSLRAVIFITKRGLKVCADPQATWVRDVVRSMDRKSNTRNNMIQTKPT

GTQQSTNTAVTLTG.

In some embodiments the ligand XCL1 comprises an amino acid sequence having 60%, 65%, 70%, 75%, 80%, 85%, 90%, or 95% sequence identity to SEQ ID NO: 1456. In some embodiments the ligand XCL1 comprises an amino acid sequence of SEQ ID NO: 1456. In some embodiments the ligand XCL1 comprises an amino acid sequence of SEQ ID NO: 1456, or a functional fragment thereof.

In another illustrative embodiment, the targeting moiety is CCL1, which is a chemokine that recognizes and binds to CCR8. In another illustrative embodiment, the targeting moiety is CCL2, which is a chemokine that recognizes and binds to CCR2 or CCR9. In another illustrative embodiment, the targeting moiety is CCL3, which is a chemokine that recognizes and binds to CCR1, CCR5, or CCR9. In another illustrative embodiment, the targeting moiety is CCL4, which is a chemokine that recognizes and binds to CCR1 or CCR5 or CCR9. In another illustrative embodiment, the targeting moiety is CCL5, which is a chemokine that recognizes and binds to CCR1 or CCR3 or CCR4 or CCR5. In another illustrative embodiment, the targeting moiety is CCL6, which is a chemokine that recognizes and binds to CCR1. In another illustrative embodiment, the targeting moiety is CCL7, which is a chemokine that recognizes and binds to CCR2 or CCR9. In another illustrative embodiment, the targeting moiety is CCL8, which is a chemokine that recognizes and binds to CCR1 or CCR2 or CCR2B or CCR5 or CCR9. In another illustrative embodiment, the targeting moiety is CCL9, which is a chemokine that recognizes and binds to CCR1. In another illustrative embodiment, the targeting moiety is CCL10, which is a chemokine that recognizes and binds to CCR1. In another illustrative embodiment, the targeting moiety is CCL11, which is a chemokine that recognizes and binds to CCR2 or CCR3 or CCR5 or CCR9. In another illustrative embodiment, the targeting moiety is CCL13, which is a chemokine that recognizes and binds to CCR2 or CCR3 or CCR5 or CCR9. In another illustrative embodiment, the targeting moiety is CCL14, which is a chemokine that recognizes and binds to CCR1 or CCR9. In another illustrative embodiment, the targeting moiety is CCL15, which is a chemokine that recognizes and binds to CCR1 or CCR3. In another illustrative embodiment, the targeting moiety is CCL16, which is a chemokine that recognizes and binds to CCR1, CCR2, CCR5, or CCR8. In another illustrative embodiment, the targeting moiety is CCL17, which is a chemokine that recognizes and binds to CCR4. In another illustrative embodiment, the targeting moiety is CCL19, which is a chemokine that recognizes and binds to CCR7. In another illustrative embodiment, the targeting moiety is CCL20, which is a chemokine that recognizes and binds to CCR6. In another illustrative embodiment, the targeting moiety is CCL21, which is a chemokine that recognizes and binds to CCR7. In another illustrative embodiment, the targeting moiety is CCL22, which is a chemokine that recognizes and binds to CCR4. In another illustrative embodiment, the targeting moiety is CCL23, which is a chemokine that recognizes and binds to CCR1. In another illustrative embodiment, the targeting moiety is CCL24, which is a chemokine that recognizes and binds to CCR3. In another illustrative embodiment, the targeting moiety is CCL25, which is a chemokine that recognizes and binds to CCR9. In another illustrative embodiment, the targeting moiety is CCL26, which is a chemokine that recognizes and binds to CCR3. In another illustrative embodiment, the targeting moiety is CCL27, which is a chemokine that recognizes and binds to CCR10. In another illustrative embodiment, the targeting moiety is CCL28, which is a chemokine that recognizes and binds to CCR3 or CCR10. In another illustrative embodiment, the targeting moiety is CXCL1, which is a chemokine that recognizes and binds to CXCR1 or CXCR2. In another illustrative embodiment, the targeting moiety is CXCL2, which is a chemokine that recognizes and binds to CXCR2. In another illustrative embodiment, the targeting moiety is CXCL3, which is a chemokine that recognizes and binds to CXCR2. In another illustrative embodiment, the targeting moiety is CXCL4, which is a chemokine that recognizes and binds to CXCR3B. In another illustrative embodiment, the targeting moiety is CXCL5, which is a chemokine that recognizes and binds to CXCR2. In another illustrative embodiment, the targeting moiety is CXCL6, which is a chemokine that recognizes and binds to CXCR1 or CXCR2. In another illustrative embodiment, the targeting moiety is CXCL8, which is a chemokine that recognizes and binds to CXCR1 or CXCR2. In another illustrative embodiment, the targeting moiety is CXCL9, which is a chemokine that recognizes and binds to CXCR3. In another illustrative embodiment, the targeting moiety is CXCL10, which is a chemokine that recognizes and binds to CXCR3. In another illustrative embodiment, the targeting moiety is CXCL11, which is a chemokine that recognizes and binds to CXCR3 or CXCR7. In another illustrative embodiment, the targeting moiety is CXCL12, which is a chemokine that recognizes and binds to CXCR4 or CXCR7. In another illustrative embodiment, the targeting moiety is CXCL13, which is a chemokine that recognizes and binds to CXCR5. In another illustrative embodiment, the targeting moiety is CXCL16, which is a chemokine that recognizes and binds to CXCR6. In another illustrative embodiment, the targeting moiety is LDGF-PBP, which is a chemokine that recognizes and binds to CXCR2. In another illustrative embodiment, the targeting moiety is XCL2, which is a chemokine that recognizes and binds to XCR1. In another illustrative embodiment, the targeting moiety is CX3CL1, which is a chemokine that recognizes and binds to CX3CR1.

In various embodiments, the present chimeric protein or chimeric protein complex comprises targeting moieties in various combinations. In an illustrative embodiment, the present chimeric protein or chimeric protein complex may comprise two targeting moieties, wherein both targeting moieties are antibodies or derivatives thereof. In another illustrative embodiment, the present chimeric protein or chimeric protein complex may comprise two targeting moieties, wherein both targeting moieties are natural ligands for cell receptors. In a further illustrative embodiment, the present chimeric protein or chimeric protein complex may comprise two targeting moieties, wherein one of the targeting moieties is an antibody or derivative thereof, and the other targeting moiety is a natural ligand for a cell receptor.

In various embodiments, the recognition domain of the present chimeric protein or chimeric protein complex functionally modulates (by way of non-limitation, partially or completely neutralizes) the target (e.g., antigen, receptor) of interest, e.g., substantially inhibiting, reducing, or neutralizing a biological effect that the antigen has. For example, various recognition domains may be directed against one or more tumor antigens that are actively suppressing, or have the capacity to suppress, the immune system of, for example, a patient bearing a tumor. For example, in some embodiments, the present chimeric protein or chimeric protein complex functionally modulates immune inhibitory signals (e.g., checkpoint inhibitors), for example, one or more of TIM-3, BTLA, PD-1, CTLA-4, B7-H4, GITR, galectin-9, HVEM, PD-L1, PD-L2, B7-H3, CD244, CD160, TIGIT, SIRPα, ICOS, CD172a, and TMIGD2. For example, in some embodiments, the present chimeric protein or chimeric protein complex is engineered to disrupt, block, reduce, and/or inhibit the transmission of an immune inhibitory signal, by way of non-limiting example, the binding of PD-1 with PD-L1 or PD-L2 and/or the binding of CTLA-4 with one or more of AP2M1, CD80, CD86, SHP-2, and PPP2R5A.

In various embodiments, the recognition domain of the present chimeric protein or chimeric protein complex binds but does not functionally modulate the target (e.g., antigen, receptor) of interest, e.g., the recognition domain is, or is akin to, a binding antibody. For instance, in various embodiments, the recognition domain simply targets the antigen or receptor but does not substantially inhibit, reduce or functionally modulate a biological effect that the antigen or receptor has. For example, some of the smaller antibody formats described above (e.g., as compared to, for example, full antibodies) have the ability to target hard to access epitopes and provide a larger spectrum of specific binding locales. In various embodiments, the recognition domain binds an epitope that is physically separate from an antigen or receptor site that is important for its biological activity (e.g., the antigen's active site). Such non-neutralizing binding finds use in various embodiments of the present invention, including methods in which the present chimeric protein or chimeric protein complex is used to directly or indirectly recruit active immune cells to a site of need via an effector antigen, such as any of those described herein. For example, in various embodiments, the present chimeric protein or chimeric protein complex may be used to directly or indirectly recruit cytotoxic T cells via CD8 to a tumor cell in a method of reducing or eliminating a tumor (e.g., the chimeric protein or chimeric protein complex may comprise an anti-CD8 recognition domain and a recognition domain directed against a tumor antigen). In such embodiments, it is desirable to directly or indirectly recruit CD8-expressing cytotoxic T cells but not to functionally modulate the CD8 activity. On the contrary, in these embodiments, CD8 signaling is an important piece of the tumor reducing or eliminating effect. By way of further example, in various methods of reducing or eliminating tumors, the present chimeric protein or chimeric protein complex is used to directly or indirectly recruit dendritic cells (DCs) via CLEC4C (e.g., the chimeric protein or chimeric protein complex may comprise an anti-CLEC4C recognition domain and a recognition domain directed against a tumor antigen). In such embodiments, it is desirable to directly or indirectly recruit CLEC4C-expressing DCs but not to functionally modulate the CLEC4C activity. On the contrary, in these embodiments, CLEC4C signaling is an important piece of the tumor reducing or eliminating effect.

In various embodiments, the recognition domain of the present chimeric protein or chimeric protein complex binds to XCR1 e.g., on dendritic cells. For instance, the recognition domain, in some embodiments, comprises all or part of XCL1 or XCL2 or an anti-XCR1 agent, which is optionally non-neutralizing.

In various embodiments, the recognition domain of the present chimeric protein or chimeric protein complex binds to an immune modulatory antigen (e.g., immune stimulatory or immune inhibitory). In various embodiments, the immune modulatory antigen is one or more of 4-1BB, OX-40, HVEM, GITR, CD27, CD28, CD30, CD40, ICOS ligand; OX-40 ligand, LIGHT (CD258), GITR ligand, CD70, B7-1, B7-2, CD30 ligand, CD40 ligand, ICOS, ICOS ligand, CD137 ligand and TL1A. In various embodiments, such immune stimulatory antigens are expressed on a tumor cell. In various embodiments, the recognition domain of the present chimeric protein or chimeric protein complex binds but does not functionally modulate such immune stimulatory antigens and therefore allows recruitment of cells expressing these antigens without the reduction or loss of their potential tumor reducing or eliminating capacity.

In various embodiments, the recognition domain of the present chimeric protein or chimeric protein complex may be in the context of chimeric protein or chimeric protein complex that comprises two recognition domains that have neutralizing activity, or comprises two recognition domains that have non-neutralizing (e.g., binding) activity, or comprises one recognition domain that has neutralizing activity and one recognition domain that has non-neutralizing (e.g., binding) activity.

In various embodiments, the multi-specific chimeric protein or chimeric protein complex has targeting moieties having recognition domains which specifically bind to a target (e.g. antigen, receptor) that is part of a non-cellular structure. In some embodiments, the antigen or receptor is not an integral component of an intact cell or cellular structure. In some embodiments, the antigen or receptor is an extracellular antigen or receptor. In some embodiments, the target is a non-proteinaceous, non-cellular marker, including, without limitation, nucleic acids, inclusive of DNA or RNA, such as, for example, DNA released from necrotic tumor cells or extracellular deposits such as cholesterol.

In some embodiments, the target (e.g. antigen, receptor) of interest is part of the non-cellular component of the stroma or the extracellular matrix (ECM) or the markers associated therewith. As used herein, stroma refers to the connective and supportive framework of a tissue or organ. Stroma may include a compilation of cells such as fibroblasts/myofibroblasts, glial, epithelia, fat, immune, vascular, smooth muscle, and immune cells along with the extracellular matrix (ECM) and extracellular molecules. In various embodiments, the target (e.g. antigen, receptor) of interest is part of the non-cellular component of the stroma such as the extracellular matrix and extracellular molecules. As used herein, the ECM refers to the non-cellular components present within all tissues and organs. The ECM is composed of a large collection of biochemically distinct components including, without limitation, proteins, glycoproteins, proteoglycans, and polysaccharides. These components of the ECM are usually produced by adjacent cells and secreted into the ECM via exocytosis. Once secreted, the ECM components often aggregate to form a complex network of macromolecules. In various embodiments, the chimeric protein or chimeric protein complex of the invention comprises a targeting moiety that recognizes a target (e.g., an antigen or receptor or non-proteinaceous molecule) located on any component of the ECM. Illustrative components of the ECM include, without limitation, the proteoglycans, the non-proteoglycan polysaccharides, fibers, and other ECM proteins or ECM non-proteins, e.g. polysaccharides and/or lipids, or ECM associated molecules (e.g. proteins or non-proteins, e.g. polysaccharides, nucleic acids and/or lipids).

In some embodiments, the targeting moiety recognizes a target (e.g. antigen, receptor) on ECM proteoglycans. Proteoglycans are glycosylated proteins. The basic proteoglycan unit includes a core protein with one or more covalently attached glycosaminoglycan (GAG) chains. Proteoglycans have a net negative charge that attracts positively charged sodium ions (Na+), which attracts water molecules via osmosis, keeping the ECM and resident cells hydrated. Proteoglycans may also help to trap and store growth factors within the ECM. Illustrative proteoglycans that may be targeted by the chimeric proteins or chimeric protein complexes of the invention include, but are not limited to, heparan sulfate, chondroitin sulfate, and keratan sulfate. In an embodiment, the targeting moiety recognizes a target (e.g. antigen, receptor) on non-proteoglycan polysaccharides such as hyaluronic acid.

In some embodiments, the targeting moiety recognizes a target (e.g. antigen, receptor) on ECM fibers. ECM fibers include collagen fibers and elastin fibers. In some embodiments, the targeting moiety recognizes one or more epitopes on collagens or collagen fibers. Collagens are the most abundant proteins in the ECM. Collagens are present in the ECM as fibrillar proteins and provide structural support to resident cells. In one or more embodiments, the targeting moiety recognizes and binds to various types of collagens present within the ECM including, without limitation, fibrillar collagens (types I, II, III, V, XI), facit collagens (types IX, XII, XIV), short chain collagens (types VIII, X), basement membrane collagens (type IV), and/or collagen types VI, VII, or XIII. Elastin fibers provide elasticity to tissues, allowing them to stretch when needed and then return to their original state. In some embodiments, the target moiety recognizes one or more epitopes on elastins or elastin fibers.

In some embodiments, the targeting moiety recognizes one or more ECM proteins including, but not limited to, a tenascin, a fibronectin, a fibrin, a laminin, or a nidogen/entactin.

In an embodiment, the targeting moiety recognizes and binds to tenascin. The tenascin (TN) family of glycoproteins includes at least four members, tenascin-C, tenascin-R, tenascin-X, and tenascin W. The primary structures of tenascin proteins include several common motifs ordered in the same consecutive sequence: amino-terminal heptad repeats, epidermal growth factor (EGF)-like repeats, fibronectin type III domain repeats, and a carboxyl-terminal fibrinogen-like globular domain. Each protein member is associated with typical variations in the number and nature of EGF-like and fibronectin type III repeats. Isoform variants also exist particularly with respect to tenascin-C. Over 27 splice variants and/or isoforms of tenascin-C are known. In a particular embodiment, the targeting moiety recognizes and binds to tenascin-CA1. Similarly, tenascin-R also has various splice variants and isoforms. Tenascin-R usually exists as dimers or trimers. Tenascin-X is the largest member of the tenascin family and is known to exist as trimers. Tenascin-W exists as trimers. In some embodiments, the targeting moiety recognizes one or more epitopes on a tenascin protein. In some embodiments, the targeting moiety recognizes the monomeric and/or the dimeric and/or the trimeric and/or the hexameric forms of a tenascin protein.

In an embodiment, the targeting moieties recognize and bind to fibronectin. Fibronectins are glycoproteins that connect cells with collagen fibers in the ECM, allowing cells to move through the ECM. Upon binding to integrins, fibronectins unfold to form functional dimers. In some embodiments, the targeting moiety recognizes the monomeric and/or the dimeric forms of fibronectin. In some embodiments, the targeting moiety recognizes one or more epitopes on fibronectin. In illustrative embodiments, the targeting moiety recognizes fibronectin extracellular domain A (EDA) or fibronectin extracellular domain B (EDB). Elevated levels of EDA are associated with various diseases and disorders including psoriasis, rheumatoid arthritis, diabetes, and cancer. In some embodiments, the targeting moiety recognizes fibronectin that contains the EDA isoform and may be utilized to target the chimeric protein or chimeric protein complex to diseased cells including cancer cells. In some embodiments, the targeting moiety recognizes fibronectin that contains the EDB isoform. In various embodiments, such targeting moieties may be utilized to target the chimeric protein or chimeric protein complex to tumor cells including the tumor neovasculature.

In an embodiment, the targeting moiety recognizes and binds to fibrin. Fibrin is another protein substance often found in the matrix network of the ECM. Fibrin is formed by the action of the protease thrombin on fibrinogen which causes the fibrin to polymerize. In some embodiments, the targeting moiety recognizes one or more epitopes on fibrin. In some embodiments, the targeting moiety recognizes the monomeric as well as the polymerized forms of fibrin.

In an embodiment, the targeting moiety recognizes and binds to laminin. Laminin is a major component of the basal lamina, which is a protein network foundation for cells and organs. Laminins are heterotrimeric proteins that contain an α-chain, a β-chain, and a γ-chain. In some embodiments, the targeting moiety recognizes one or more epitopes on laminin. In some embodiments, the targeting moiety recognizes the monomeric, the dimeric as well as the trimeric forms of laminin.

In an embodiment, the targeting moiety recognizes and binds to a nidogen or entactin. Nidogens/entactins are a family of highly conserved, sulfated glycoproteins. They make up the major structural component of the basement membranes and function to link laminin and collagen IV networks in basement membranes. Members of this family include nidogen-1 and nidogen-2. In various embodiments, the targeting moiety recognizes an epitope on nidogen-1 and/or nidogen-2.

In various embodiments, the targeting moiety comprises an antigen recognition domain that recognizes an epitope present on any of the targets (e.g., ECM proteins) described herein. In an embodiment, the antigen-recognition domain recognizes one or more linear epitopes present on the protein. As used herein, a linear epitope refers to any continuous sequence of amino acids present on the protein. In another embodiment, the antigen-recognition domain recognizes one or more conformational epitopes present on the protein. As used herein, a conformation epitope refers to one or more sections of amino acids (which may be discontinuous) which form a three-dimensional surface with features and/or shapes and/or tertiary structures capable of being recognized by an antigen recognition domain.

In various embodiments, the targeting moiety may bind to the full-length and/or mature forms and/or isoforms and/or splice variants and/or fragments and/or any other naturally occurring or synthetic analogs, variants, or mutants of any of the targets (e.g., ECM proteins) described herein. In various embodiments, the targeting moiety may bind to any forms of the proteins described herein, including monomeric, dimeric, trimeric, tetrameric, heterodimeric, multimeric and associated forms. In various embodiments, the targeting moiety may bind to any post-translationally modified forms of the proteins described herein, such as glycosylated and/or phosphorylated forms.

In various embodiments, the targeting moiety comprises an antigen recognition domain that recognizes extracellular molecules such as DNA. In some embodiments, the targeting moiety comprises an antigen recognition domain that recognizes DNA. In an embodiment, the DNA is shed into the extracellular space from necrotic or apoptotic tumor cells or other diseased cells.

In various embodiments, the targeting moiety comprises an antigen recognition domain that recognizes one or more non-cellular structures associated with atherosclerotic plaques. Two types of atherosclerotic plaques are known. The fibro-lipid (fibro-fatty) plaque is characterized by an accumulation of lipid-laden cells underneath the intima of the arteries. Beneath the endothelium there is a fibrous cap covering the atheromatous core of the plaque. The core includes lipid-laden cells (macrophages and smooth muscle cells) with elevated tissue cholesterol and cholesterol ester content, fibrin, proteoglycans, collagen, elastin, and cellular debris. In advanced plaques, the central core of the plaque usually contains extracellular cholesterol deposits (released from dead cells), which form areas of cholesterol crystals with empty, needle-like clefts. At the periphery of the plaque are younger foamy cells and capillaries. A fibrous plaque is also localized under the intima, within the wall of the artery resulting in thickening and expansion of the wall and, sometimes, spotty localized narrowing of the lumen with some atrophy of the muscular layer. The fibrous plaque contains collagen fibers (eosinophilic), precipitates of calcium (hematoxylinophilic) and lipid-laden cells. In some embodiments, the targeting moiety recognizes and binds to one or more of the non-cellular components of these plaques such as the fibrin, proteoglycans, collagen, elastin, cellular debris, and calcium or other mineral deposits or precipitates. In some embodiments, the cellular debris is a nucleic acid, e.g. DNA or RNA, released from dead cells.

In various embodiments, the targeting moiety comprises an antigen recognition domain that recognizes one or more non-cellular structures found in the brain plaques associated with neurodegenerative diseases. In some embodiments, the targeting moiety recognizes and binds to one or more non-cellular structures located in the amyloid plaques found in the brains of patients with Alzheimer's disease. For example, the targeting moiety may recognize and bind to the peptide amyloid beta, which is a major component of the amyloid plaques. In some embodiments, the targeting moiety recognizes and binds to one or more non-cellular structures located in the brains plaques found in patients with Huntington's disease. In various embodiments, the targeting moiety recognizes and binds to one or more non-cellular structures found in plaques associated with other neurodegenerative or musculoskeletal diseases such as Lewy body dementia and inclusion body myositis.

Linkers and Functional Groups

In various embodiments, the Clec4C binding agent may include one or more functional groups, residues, or moieties. In various embodiments, the one or more functional groups, residues, or moieties are attached or genetically fused to any of the signaling agents or targeting moieties (e.g., Clec4C) described herein. In some embodiments, such functional groups, residues or moieties confer one or more desired properties or functionalities to the Clec4C binding agent of the invention. Examples of such functional groups and of techniques for introducing them into the Clec4C binding agent are known in the art, for example, see *Remington's Pharmaceutical Sciences,* 16th ed., Mack Publishing Co., Easton, Pa. (1980).

In various embodiments, the Clec4C binding agent may by conjugated and/or fused with another agent to extend half-life or otherwise improve pharmacodynamic and pharmacokinetic properties. In some embodiments, the Clec4C binding agent may be fused or conjugated with one or more of PEG, XTEN (e.g., as rPEG), polysialic acid (POLYXEN), albumin (e.g., human serum albumin or HAS), elastin-like protein (ELP), PAS, HAP, GLK, CTP, transferrin, and the like. In some embodiments, the Clec4C binding agent may be fused or conjugated with an antibody or an antibody fragment such as an Fc fragment. For example, the Clec4C binding agent may be fused to either the N-terminus or the C-terminus of the Fc domain of human immunoglobulin (Ig) G. In various embodiments, each of the individual chimeric proteins or chimeric protein complexes is fused to one or more of the agents described in BioDrugs (2015) 29:215-239, the entire contents of which are hereby incorporated by reference.

In some embodiments, the functional groups, residues, or moieties comprise a suitable pharmacologically acceptable polymer, such as poly(ethyleneglycol) (PEG) or derivatives thereof (such as methoxypoly(ethyleneglycol) or mPEG). In some embodiments, attachment of the PEG moiety increases the half-life and/or reduces the immunogenicity of the Clec4C binding agent. Generally, any suitable form of pegylation can be used, such as the pegylation used in the art for antibodies and antibody fragments (including but not limited to single domain antibodies such as VHHs); see, for example, Chapman, *Nat. Biotechnol.*, 54, 531-545 (2002); by Veronese and Harris, *Adv. Drug Deliv. Rev.* 54, 453-456 (2003), by Harris and Chess, *Nat. Rev. Drug. Discov.*, 2, (2003) and in WO04060965, the entire contents of which are hereby incorporated by reference. Various reagents for pegylation of proteins are also commercially available, for example, from Nektar Therapeutics, USA. In some embodiments, site-directed pegylation is used, in particular via a cysteine-residue (see, for example, Yang et al., Protein Engineering, 16, 10, 761-770 (2003), the entire contents of which is hereby incorporated by reference). For example, for this purpose, PEG may be attached to a cysteine residue that naturally occurs in the present chimeric protein or chimeric protein complex of the invention. In some embodiments, the present chimeric protein or chimeric protein complex of the invention is modified so as to suitably introduce one or more cysteine residues for attachment of PEG, or an amino acid sequence comprising one or more cysteine residues for attachment of PEG may be fused to the amino- and/or carboxy-terminus of the present chimeric protein, using techniques known in the art.

In some embodiments, the functional groups, residues, or moieties comprise N-linked or O-linked glycosylation. In some embodiments, the N-linked or O-linked glycosylation is introduced as part of a co-translational and/or post-translational modification.

In some embodiments, the functional groups, residues, or moieties comprise one or more detectable labels or other signal-generating groups or moieties. Suitable labels and techniques for attaching, using and detecting them are known in the art and, include, but are not limited to, fluorescent labels (such as fluorescein, isothiocyanate, rhodamine, phycoerythrin, phycocyanin, allophycocyanin, o-phthaldehyde, and fluorescamine and fluorescent metals such as Eu or others metals from the lanthanide series), phosphorescent labels, chemiluminescent labels or bioluminescent labels (such as luminal, isoluminol, theromatic acridinium ester, imidazole, acridinium salts, oxalate ester, dioxetane or GFP and its analogs), radio-isotopes, metals, metals chelates or metallic cations or other metals or metallic cations that are particularly suited for use in in vivo, in vitro or in situ diagnosis and imaging, as well as chromophores and enzymes (such as malate dehydrogenase, staphylococcal nuclease, delta-V-steroid isomerase, yeast alcohol dehydrogenase, alpha-glycerophosphate dehydrogenase, triose phosphate isomerase, biotinavidin peroxidase, horseradish peroxidase, alkaline phosphatase, asparaginase, glucose oxidase, beta-galactosidase, ribonuclease, urease, catalase, glucose-VI-phosphate dehydrogenase, glucoamylase and acetylcholine esterase). Other suitable labels include moieties that can be detected using NMR or ESR spectroscopy. Such labeled VHHs and polypeptides of the invention may, for example, be used for in vitro, in vivo or in situ assays (including immunoassays known per se such as ELISA, RIA, EIA and other "sandwich assays," etc.) as well as in vivo diagnostic and imaging purposes, depending on the choice of the specific label.

In some embodiments, the functional groups, residues, or moieties comprise a tag that is attached or genetically fused to the chimeric protein. In some embodiments, the present chimeric protein or chimeric protein complex may include a single tag or multiple tags. The tag for example is a peptide, sugar, or DNA molecule that does not inhibit or prevent binding of the Clec4C binding agent to Clec4C or any other antigen of interest such as tumor antigens. In various embodiments, the tag is at least about: three to five amino acids long, five to eight amino acids long, eight to twelve amino acids long, twelve to fifteen amino acids long, or fifteen to twenty amino acids long. Illustrative tags are described for example, in U.S. Patent Publication No. US2013/0058962. In some embodiment, the tag is an affinity tag such as glutathione-S-transferase (GST) and histidine (His) tag. In an embodiment, the present chimeric protein or chimeric protein complex comprises a His tag.

In some embodiments, the functional groups, residues, or moieties comprise a chelating group, for example, to chelate one of the metals or metallic cations. Suitable chelating groups, for example, include, without limitation, diethylenetriaminepentaacetic acid (DTPA) or ethylenediaminetetraacetic acid (EDTA).

In some embodiments, the functional groups, residues, or moieties comprise a functional group that is one part of a specific binding pair, such as the biotin-(strept)avidin binding pair. Such a functional group may be used to link the present chimeric protein or chimeric protein complex of the invention to another protein, polypeptide or chemical compound that is bound to the other half of the binding pair, i.e., through formation of the binding pair. For example, a present chimeric protein or chimeric protein complex of the invention may be conjugated to biotin, and linked to another protein, polypeptide, compound or carrier conjugated to avidin or streptavidin. For example, such a conjugated present chimeric protein or chimeric protein complex may be used as a reporter, for example, in a diagnostic system where a detectable signal-producing agent is conjugated to avidin or streptavidin. Such binding pairs may, for example, also be used to bind the present chimeric protein or chimeric protein complex to a carrier, including carriers suitable for pharmaceutical purposes. One non-limiting example are the liposomal formulations described by Cao and Suresh, *Journal of Drug Targeting*, 8, 4, 257 (2000). Such binding pairs may also be used to link a therapeutically active agent to the chimeric protein or chimeric protein complex of the invention.

In some embodiments, the present chimeric protein or chimeric protein complex optionally comprises one or more linkers. In some embodiments, the present chimeric protein or chimeric protein complex comprises a linker connecting the targeting moiety and the signaling agent. In some embodiments, the present chimeric protein or chimeric protein complex comprises a linker within the signaling agent (e.g. in the case of single chain TNF, which can comprise two linkers to yield a trimer).

In some embodiments, vectors encoding the present chimeric proteins or chimeric protein complexes linked as a single nucleotide sequence to any of the linkers described herein are provided and may be used to prepare such chimeric proteins or chimeric protein complexes or chimeric protein complexes.

In some embodiments, the linker length allows for efficient binding of a targeting moiety and the signaling agent to their receptors. For instance, in some embodiments, the linker length allows for efficient binding of one of the targeting moieties and the signaling agent to receptors on the same cell as well as the efficient binding of the other targeting moiety to another cell. Illustrative pairs of cells are provided elsewhere herein.

In some embodiments the linker length is at least equal to the minimum distance between the binding sites of one of the targeting moieties and the signaling agent to receptors on the same cell. In some embodiments the linker length is at least twice, or three times, or four times, or five times, or ten times, or twenty times, or 25 times, or 50 times, or one hundred times, or more the minimum distance between the binding sites of one of the targeting moieties and the signaling agent to receptors on the same cell.

As described herein, the linker length allows for efficient binding of one of the targeting moieties and the signaling agent to receptors on the same cell, the binding being sequential, e.g. targeting moiety/receptor binding preceding signaling agent/receptor binding.

In some embodiments, there are two linkers in a single chimera, each connecting the signaling agent to a targeting moiety. In various embodiments, the linkers have lengths that allow for the formation of a site that has a disease cell and an effector cell without steric hindrance that would prevent modulation of the either cell.

The invention contemplates the use of a variety of linker sequences. In various embodiments, the linker may be derived from naturally-occurring multi-domain proteins or are empirical linkers as described, for example, in Chichili et al., (2013), Protein Sci. 22(2):153-167, Chen et al., (2013), Adv Drug Deliv Rev. 65(10):1357-1369, the entire contents of which are hereby incorporated by reference. In some embodiments, the linker may be designed using linker designing databases and computer programs such as those described in Chen et al., (2013), Adv Drug Deliv Rev. 65(10):1357-1369 and Crasto et al., (2000), Protein Eng. 13(5):309-312, the entire contents of which are hereby incorporated by reference. In various embodiments, the linker may be functional. For example, without limitation, the linker may function to improve the folding and/or stability, improve the expression, improve the pharmacokinetics, and/or improve the bioactivity of the present chimeric protein.

In some embodiments, the linker is a polypeptide. In some embodiments, the linker is less than about 100 amino acids long. For example, the linker may be less than about 100, about 95, about 90, about 85, about 80, about 75, about 70, about 65, about 60, about 55, about 50, about 45, about 40, about 35, about 30, about 25, about 20, about 19, about 18, about 17, about 16, about 15, about 14, about 13, about 12, about 11, about 10, about 9, about 8, about 7, about 6, about 5, about 4, about 3, or about 2 amino acids long. In some embodiments, the linker is a polypeptide. In some embodiments, the linker is greater than about 100 amino acids long. For example, the linker may be greater than about 100, about 95, about 90, about 85, about 80, about 75, about 70, about 65, about 60, about 55, about 50, about 45, about 40, about 35, about 30, about 25, about 20, about 19, about 18, about 17, about 16, about 15, about 14, about 13, about 12, about 11, about 10, about 9, about 8, about 7, about 6, about 5, about 4, about 3, or about 2 amino acids long. In some embodiments, the linker is flexible. In another embodiment, the linker is rigid.

In some embodiments, a linker connects the two targeting moieties to each other and this linker has a short length and a linker connects a targeting moiety and a signaling agent this linker is longer than the linker connecting the two targeting moieties. For example, the difference in amino acid length between the linker connecting the two targeting moieties and the linker connecting a targeting moiety and a signaling agent may be about 100, about 95, about 90, about 85, about 80, about 75, about 70, about 65, about 60, about 55, about 50, about 45, about 40, about 35, about 30, about 25, about 20, about 19, about 18, about 17, about 16, about 15, about 14, about 13, about 12, about 11, about 10, about 9, about 8, about 7, about 6, about 5, about 4, about 3, or about 2 amino acids.

In various embodiments, the linker is substantially comprised of glycine and serine residues (e.g. about 30%, or about 40%, or about 50%, or about 60%, or about 70%, or about 80%, or about 90%, or about 95%, or about 97% glycines and serines). For example, in some embodiments, the linker is (Gly$_4$Ser)$_n$, where n is from about 1 to about 8, e.g. 1, 2, 3, 4, 5, 6, 7, or 8 (SEQ ID NO: 247-SEQ ID NO: 254). In an embodiment, the linker sequence is GGSGGSGGGGSGGGGS (SEQ ID NO: 255). Additional illustrative linkers include, but are not limited to, linkers having the sequence LE, GGGGS (SEQ ID NO: 247), (GGGGS)$_n$ (n=1-4) (SEQ ID NO: 247-SEQ ID NO: 250), (Gly)$_8$ (SEQ ID NO: 256), (Gly)$_6$ (SEQ ID NO: 257), (EAAAK)$_n$ (n=1-3) (SEQ ID NO: 258-SEQ ID NO: 260), A(EAAAK)$_n$A (n=2-5) (SEQ ID NO: 261-SEQ ID NO: 264), AEAAAKEAAAKA (SEQ ID NO: 261), A(EAAAK)$_4$ALEA(EAAAK)$_4$A (SEQ ID NO: 265), PAPAP (SEQ ID NO: 266), KESGSVSSEQLAQFRSLD (SEQ ID NO: 267), EGKSSGSGSESKST (SEQ ID NO: 268), GSAGSAAGSGEF (SEQ ID NO: 269), and (XP)$_n$, with X designating any amino acid, e.g., Ala, Lys, or Glu. In various embodiments, the linker is (GGS)$_n$ (n=1-20) (SEQ ID NOs: 1162-1181). In some embodiments, the linker is G. In some embodiments, the linker is AAA. In some embodiments, the linker is (GGGGS)$_n$ (n=5-20) (SEQ ID NOs: 251-254 and SEQ ID NOs: 1182-1193).

In some embodiments, the linker is one or more of GGGSE (SEQ ID NO: 270), GSESG (SEQ ID NO: 271), GSEGS (SEQ ID NO: 272), GEGGSGEGSSGEGSSSEGGGSEGGGSEGGGSEGGS (SEQ ID NO: 273), and a linker of randomly placed G, S, and E every 4 amino acid intervals.

In some embodiments, the linker is a hinge region of an antibody (e.g., of IgG, IgA, IgD, and IgE, inclusive of subclasses (e.g. IgG1, IgG2, IgG3, and IgG4, and IgA1 and IgA2)). In various embodiments, the linker is a hinge region of an antibody (e.g., of IgG, IgA, IgD, and IgE, inclusive of subclasses (e.g. IgG1, IgG2, IgG3, and IgG4, and IgA1 and IgA2)). The hinge region, found in IgG, IgA, IgD, and IgE class antibodies, acts as a flexible spacer, allowing the Fab portion to move freely in space. In contrast to the constant regions, the hinge domains are structurally diverse, varying in both sequence and length among immunoglobulin classes and subclasses. For example, the length and flexibility of the hinge region varies among the IgG subclasses. The hinge region of IgG1 encompasses amino acids 216-231 and, because it is freely flexible, the Fab fragments can rotate about their axes of symmetry and move within a sphere centered at the first of two inter-heavy chain disulfide bridges. IgG2 has a shorter hinge than IgG1, with 12 amino acid residues and four disulfide bridges. The hinge region of IgG2 lacks a glycine residue, is relatively short, and contains a rigid poly-proline double helix, stabilized by extra inter-heavy chain disulfide bridges. These properties restrict the flexibility of the IgG2 molecule. IgG3 differs from the other subclasses by its unique extended hinge region (about four times as long as the IgG1 hinge), containing 62 amino acids (including 21 prolines and 11 cysteines), forming an inflexible poly-proline double helix. In IgG3, the Fab fragments are relatively far away from the Fc fragment, giving the molecule a greater flexibility. The elongated hinge in IgG3 is also responsible for its higher molecular weight compared to the other subclasses. The hinge region of IgG4 is shorter than that of IgG1 and its flexibility is intermediate between that of IgG1 and IgG2. The flexibility of the hinge regions reportedly decreases in the order IgG3>IgG1>IgG4>IgG2.

According to crystallographic studies, the immunoglobulin hinge region can be further subdivided functionally into three regions: the upper hinge region, the core region, and the lower hinge region. See Shin et al., 1992 *Immunological Reviews* 130:87. The upper hinge region includes amino acids from the carboxyl end of $C_{H1}$ to the first residue in the hinge that restricts motion, generally the first cysteine residue that forms an interchain disulfide bond between the two heavy chains. The length of the upper hinge region correlates with the segmental flexibility of the antibody. The core hinge region contains the inter-heavy chain disulfide bridges, and the lower hinge region joins the amino terminal end of the $C_{H2}$ domain and includes residues in $C_{H2}$. Id. The core hinge region of wild-type human IgG1 contains the sequence Cys-Pro-Pro-Cys (SEQ ID NO: 274) which, when dimerized by disulfide bond formation, results in a cyclic octapeptide believed to act as a pivot, thus conferring flexibility. In various embodiments, the present linker comprises, one, or two, or three of the upper hinge region, the core region, and the lower hinge region of any antibody (e.g., of IgG, IgA, IgD, and IgE, inclusive of subclasses (e.g. IgG1, IgG2, IgG3, and IgG4, and IgA1 and IgA2)). The hinge region may also contain one or more glycosylation sites, which include a number of structurally distinct types of sites for carbohydrate attachment. For example, IgA1 contains five glycosylation sites within a 17-amino-acid segment of the hinge region, conferring resistance of the hinge region polypeptide to intestinal proteases, considered an advantageous property for a secretory immunoglobulin. In various embodiments, the linker of the present invention comprises one or more glycosylation sites. In various embodiments, the linker is a hinge-CH2-CH3 domain of a human IgG4 antibody.

If desired, the present chimeric protein can be linked to an antibody Fc region, comprising one or both of $C_H2$ and $C_H3$ domains, and optionally a hinge region. For example, vectors encoding the present chimeric proteins or chimeric protein complexes linked as a single nucleotide sequence to an Fc region can be used to prepare such polypeptides.

In some embodiments, the linker is a synthetic linker such as PEG.

In various embodiments, the linker may be functional. For example, without limitation, the linker may function to improve the folding and/or stability, improve the expression, improve the pharmacokinetics, and/or improve the bioactivity of the present chimeric protein. In another example, the linker may function to target the chimeric protein or chimeric protein complex to a particular cell type or location.

Modifications and Production of Chimeric Proteins

In various embodiments, the Clec4C binding agent comprises a targeting moiety that is a VHH. In various embodiments, the VHH is not limited to a specific biological source or to a specific method of preparation. For example, the VHH can generally be obtained: (1) by isolating the $V_HH$ domain of a naturally occurring heavy chain antibody; (2) by expression of a nucleotide sequence encoding a naturally occurring $V_HH$ domain; (3) by "humanization" of a naturally occurring $V_HH$ domain or by expression of a nucleic acid encoding a such humanized $V_HH$ domain; (4) by "camelization" of a naturally occurring VH domain from any animal species, such as from a mammalian species, such as from a human being, or by expression of a nucleic acid encoding such a camelized VH domain; (5) by "camelization" of a "domain antibody" or "Dab" as described in the art, or by expression of a nucleic acid encoding such a camelized VH domain; (6) by using synthetic or semi-synthetic techniques for preparing proteins, polypeptides or other amino acid sequences known in the art; (7) by preparing a nucleic acid encoding a VHH using techniques for nucleic acid synthesis known in the art, followed by expression of the nucleic acid thus obtained; and/or (8) by any combination of one or more of the foregoing.

In an embodiment, the Clec4C binding agent comprises a VHH that corresponds to the $V_HH$ domains of naturally occurring heavy chain antibodies directed against human Clec4C. In some embodiments, such $V_HH$ sequences can generally be generated or obtained by suitably immunizing a species of Camelid with a Clec4C molecule, (i.e., so as to raise an immune response and/or heavy chain antibodies directed against Clec4C), by obtaining a suitable biological sample from the Camelid (such as a blood sample, or any sample of B-cells), and by generating $V_HH$ sequences directed against Clec4C starting from the sample, using any suitable known techniques. In some embodiments, naturally occurring $V_HH$ domains against Clec4C can be obtained from naive libraries of Camelid $V_HH$ sequences, for example, by screening such a library using Clec4C or at least one part, fragment, antigenic determinant or epitope thereof using one or more screening techniques known in the art. Such libraries and techniques are, for example, described in WO9937681, WO0190190, WO03025020 and WO03035694, the entire contents of which are hereby incorporated by reference. In some embodiments, improved synthetic or semi-synthetic libraries derived from naive $V_HH$ libraries may be used, such as $V_HH$ libraries obtained from naive $V_HH$ libraries by techniques such as random mutagenesis and/or CDR shuffling, as for example, described in WO0043507, the entire contents of which are hereby incorporated by reference. In some embodiments, another technique for obtaining $V_HH$ sequences directed against a Clec4C involves suitably immunizing a transgenic mammal that is capable of expressing heavy chain antibodies (i.e., so as to raise an immune response and/or heavy chain antibodies directed against Clec4C), obtaining a suitable biological sample from the transgenic mammal (such as a blood sample, or any sample of B-cells), and then generating $V_HH$ sequences directed against Clec4C starting from the sample, using any suitable known techniques. For example, for this purpose, the heavy chain antibody-expressing mice and the further methods and techniques described in WO02085945 and in WO04049794 (the entire contents of which are hereby incorporated by reference) can be used.

In an embodiment, the chimeric protein or chimeric protein complex comprises a VHH that has been "humanized" i.e., by replacing one or more amino acid residues in the amino acid sequence of the naturally occurring $V_HH$ sequence (and in particular in the framework sequences) by one or more of the amino acid residues that occur at the corresponding position(s) in a VH domain from a conventional 4-chain antibody from a human being. This can be performed using humanization techniques known in the art.

In some embodiments, possible humanizing substitutions or combinations of humanizing substitutions may be determined by methods known in the art, for example, by a comparison between the sequence of a VHH and the sequence of a naturally occurring human VH domain. In some embodiments, the humanizing substitutions are chosen such that the resulting humanized VHHs still retain advantageous functional properties. Generally, as a result of humanization, the VHHs of the invention may become more "human-like," while still retaining favorable properties such as a reduced immunogenicity, compared to the corresponding naturally occurring $V_HH$ domains. In various embodiments, the humanized VHHs of the invention can be obtained in any suitable manner known in the art and thus are not strictly limited to polypeptides that have been obtained using a polypeptide that comprises a naturally occurring $V_HH$ domain as a starting material.

In an embodiment, the chimeric protein or chimeric protein complex comprises a VHH that has been "camelized," i.e., by replacing one or more amino acid residues in the amino acid sequence of a naturally occurring VH domain from a conventional 4-chain antibody by one or more of the amino acid residues that occur at the corresponding position(s) in a $V_HH$ domain of a heavy chain antibody of a camelid. In some embodiments, such "camelizing" substitutions are inserted at amino acid positions that form and/or are present at the VH-VL interface, and/or at the so-called Camelidae hallmark residues (see, for example, WO9404678, the entire contents of which are hereby incorporated by reference). In some embodiments, the VH sequence that is used as a starting material or starting point for generating or designing the camelized VHH is a VH sequence from a mammal, for example, the VH sequence of a human being, such as a VH3 sequence. In various embodiments, the camelized VHHs can be obtained in any suitable manner known in the art (i.e., as indicated under points (1)-(8) above) and thus are not strictly limited to polypeptides that have been obtained using a polypeptide that comprises a naturally occurring VH domain as a starting material.

In various embodiments, both "humanization" and "camelization" can be performed by providing a nucleotide sequence that encodes a naturally occurring $V_HH$ domain or VH domain, respectively, and then changing, in a manner known in the art, one or more codons in the nucleotide sequence in such a way that the new nucleotide sequence encodes a "humanized" or "camelized" VHH, respectively. This nucleic acid can then be expressed in a manner known in the art, so as to provide the desired VHH of the invention. Alternatively, based on the amino acid sequence of a naturally occurring $V_HH$ domain or VH domain, respectively, the amino acid sequence of the desired humanized or camelized VHH of the invention, respectively, can be designed and then synthesized de novo using techniques for peptide synthesis known in the art. Also, based on the amino acid sequence or nucleotide sequence of a naturally occurring $V_HH$ domain or VH domain, respectively, a nucleotide sequence encoding the desired humanized or camelized VHH, respectively, can be designed and then synthesized de novo using techniques for nucleic acid synthesis known in the art, after which the nucleic acid thus obtained can be expressed in a manner known in the art, so as to provide the desired VHH of the invention. Other suitable methods and techniques for obtaining the VHHs of the invention and/or nucleic acids encoding the same, starting from naturally occurring VH sequences or $V_HH$ sequences, are known in the art, and may, for example, comprise combining one or more parts of one or more naturally occurring VH sequences (such as one or more FR sequences and/or CDR sequences), one or more parts of one or more naturally occurring $V_HH$ sequences (such as one or more FR sequences or CDR sequences), and/or one or more synthetic or semi-synthetic sequences, in a suitable manner, so as to provide a VHH of the invention or a nucleotide sequence or nucleic acid encoding the same.

Methods for producing the chimeric proteins or chimeric protein complexes of the invention are described herein. For example, DNA sequences encoding the chimeric proteins or chimeric protein complexes of the invention (e.g., DNA sequences encoding the modified signaling agent and the targeting moiety and the linker) can be chemically synthesized using methods known in the art. Synthetic DNA sequences can be ligated to other appropriate nucleotide sequences, including, e.g., expression control sequences, to produce gene expression constructs encoding the desired chimeric proteins or chimeric protein complexes. Accordingly, in various embodiments, the present invention provides for isolated nucleic acids comprising a nucleotide sequence encoding the chimeric protein or chimeric protein complex of the invention.

Nucleic acids encoding the chimeric protein or chimeric protein complex of the invention can be incorporated (ligated) into expression vectors, which can be introduced into host cells through transfection, transformation, or transduction techniques. For example, nucleic acids encoding the chimeric protein or chimeric protein complex of the invention can be introduced into host cells by retroviral transduction. Illustrative host cells are *E. coli* cells, Chinese hamster ovary (CHO) cells, human embryonic kidney 293 (HEK 293) cells, HeLa cells, baby hamster kidney (BHK) cells, monkey kidney cells (COS), human hepatocellular carcinoma cells (e.g., Hep G2), and myeloma cells. Transformed host cells can be grown under conditions that permit the host cells to express the genes that encode the chimeric protein or chimeric protein complex of the invention. Accordingly, in various embodiments, the present invention provides expression vectors comprising nucleic acids that encode the chimeric protein or chimeric protein complex of the invention. In various embodiments, the present invention additional provides host cells comprising such expression vectors.

Specific expression and purification conditions will vary depending upon the expression system employed. For example, if a gene is to be expressed in *E. coli*, it is first cloned into an expression vector by positioning the engineered gene downstream from a suitable bacterial promoter, e.g., Trp or Tac, and a prokaryotic signal sequence. In another example, if the engineered gene is to be expressed in eukaryotic host cells, e.g., CHO cells, it is first inserted into an expression vector containing for example, a suitable eukaryotic promoter, a secretion signal, enhancers, and various introns. The gene construct can be introduced into the host cells using transfection, transformation, or transduction techniques.

The chimeric protein or chimeric protein complex of the invention can be produced by growing a host cell transfected with an expression vector encoding the chimeric protein or chimeric protein complex under conditions that permit expression of the protein. Following expression, the protein can be harvested and purified using techniques well known in the art, e.g., affinity tags such as glutathione-S-transferase (GST) and histidine tags or by chromatography.

Accordingly, in various embodiments, the present invention provides for a nucleic acid encoding a chimeric protein or chimeric protein complex of the present invention. In various embodiments, the present invention provides for a host cell comprising a nucleic acid encoding a chimeric protein or chimeric protein complex of the present invention.

In various embodiments, the present Clec4C binding agent or chimeric protein or chimeric protein complex comprising the same may be expressed in vivo, for instance, in a patient. For example, in various embodiments, the present Clec4C binding agent or chimeric protein or chimeric protein complex comprising the same may be administered in the form of nucleic acid which encodes the present Clec4C binding agent or chimeric proteins or chimeric protein complexes comprising the same. In various embodiments, the nucleic acid is DNA or RNA. In some embodiments, present Clec4C binding agent or chimeric protein or chimeric protein complex comprising the same is encoded by a modified mRNA, i.e. an mRNA comprising one or more modified nucleotides. In some embodiments, the modified mRNA comprises one or modifications found in U.S. Pat. No. 8,278,036, the entire contents of which are hereby incorporated by reference. In some embodiments, the modified mRNA comprises one or more of m5C, m5U, m6A, s2U, Ψ, and 2'-O-methyl-U. In some embodiments, the present invention relates to administering a modified mRNA encoding one or more of the present chimeric proteins or chimeric protein complexes. In some embodiments, the present invention relates to gene therapy vectors comprising the same. In some embodiments, the present invention relates to gene therapy methods comprising the same. In various embodiments, the nucleic acid is in the form of an oncolytic virus, e.g. an adenovirus, reovirus, measles, herpes simplex, Newcastle disease virus or vaccinia.

Fc-Based Chimeric Protein Complexes

The present technology is based, in part, on the discovery of signaling agents, that are optionally modified to have reduced affinity or activity for one or more of its receptors, and targeting moieties that recognize and bind to a specific target. In some embodiments, one or more signaling agents and one or more targeting moieties are linked and/or conjugated and/or fused to Fc-based chimeric proteins that can pair to form Fc-based chimeric protein complexes. Such Fc-based chimeric protein complexes, surprisingly, have dramatically improved half-lives in vivo, as compared to chimeras lacking an Fc and, especially in the heterodimer configuration as described herein, are particularly amendable to production, purification, and pharmaceutical formulation due to enhanced solubility, stability and other drug-like properties. Accordingly, the present Fc-based chimeric protein complex engineering approach yields agents that are particularly suited for use as therapies.

In some embodiments, these Fc-based chimeric protein complexes may bind and directly or indirectly recruit immune cells to sites in need of therapeutic action (e.g. a tumor or tumor microenvironment). In some embodiments, the Fc-based chimeric protein complexes enhance tumor antigen presentation for elicitation of effective antitumor immune response. In some embodiments these Fc-based chimeric protein complexes may bind tumor cells, tumor microenvironment-associated cells or stromal targets. In some embodiments. These Fc-based chimeric protein complexes may bind to tissue-specific and/or cell-specific specific markers (e.g. antigens, targets) associated with disease-affected or disease-associated organs, tissues and cells. In some embodiments these Fc-based chimeric protein complexes may bind to more than one target/protein marker/antigen present on the same or different cells. In some embodiments these Fc-based chimeric protein complexes may bind to two or more cell types. In some embodiments these Fc-based chimeric protein complexes may bind to more than one cell type and promote formation of a cell complex (e.g. an immune cell and a tumor cell).

In some embodiments, the Fc-based chimeric protein complexes modulate antigen presentation. In some embodiments, the Fc-based chimeric protein complexes temper the immune response to avoid or reduce autoimmunity. In some embodiments, the Fc-based chimeric protein complexes provide immunosuppression. In some embodiments, the Fc-based chimeric protein complexes cause an increase a ratio of Tregs to CD8+ T cells and/or CD4+ T cells in a patient. In some embodiments, the present methods relate to reduction of auto-reactive T cells in a patient.

Figure 16A:
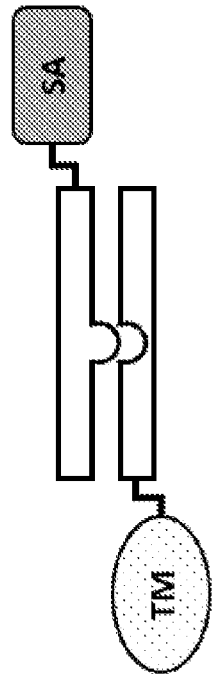
Figure 16B:
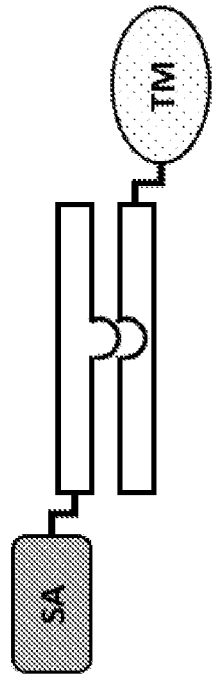
Figure 16C:
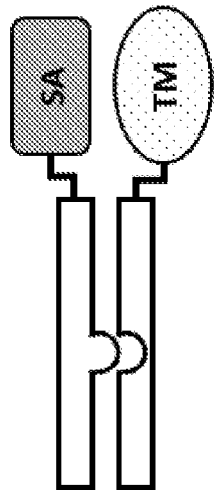
Figure 16D:
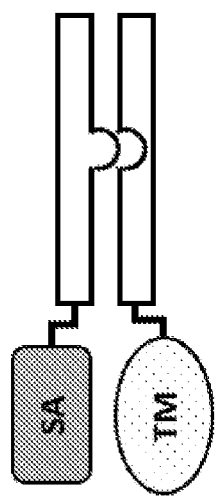
Figure 18A:
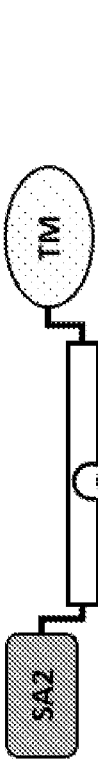
Figure 18B:
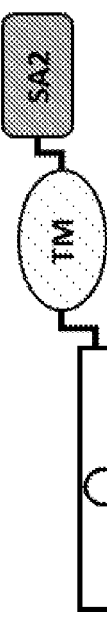
Figure 18C:
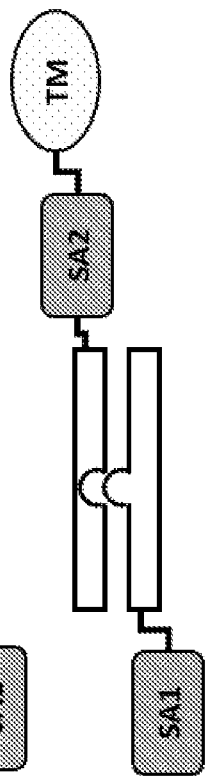
Figure 18D:
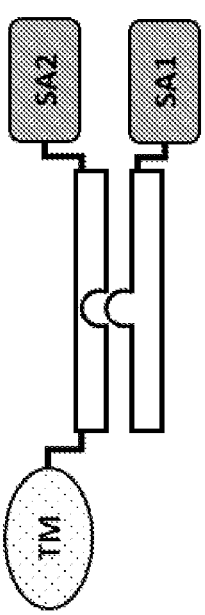
Figure 18E:
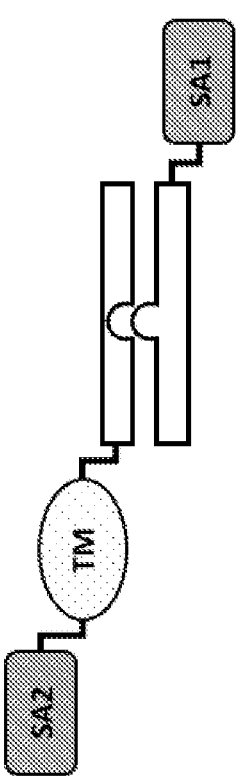
Figures 18F, 18G, 18H, 18I, 18J:
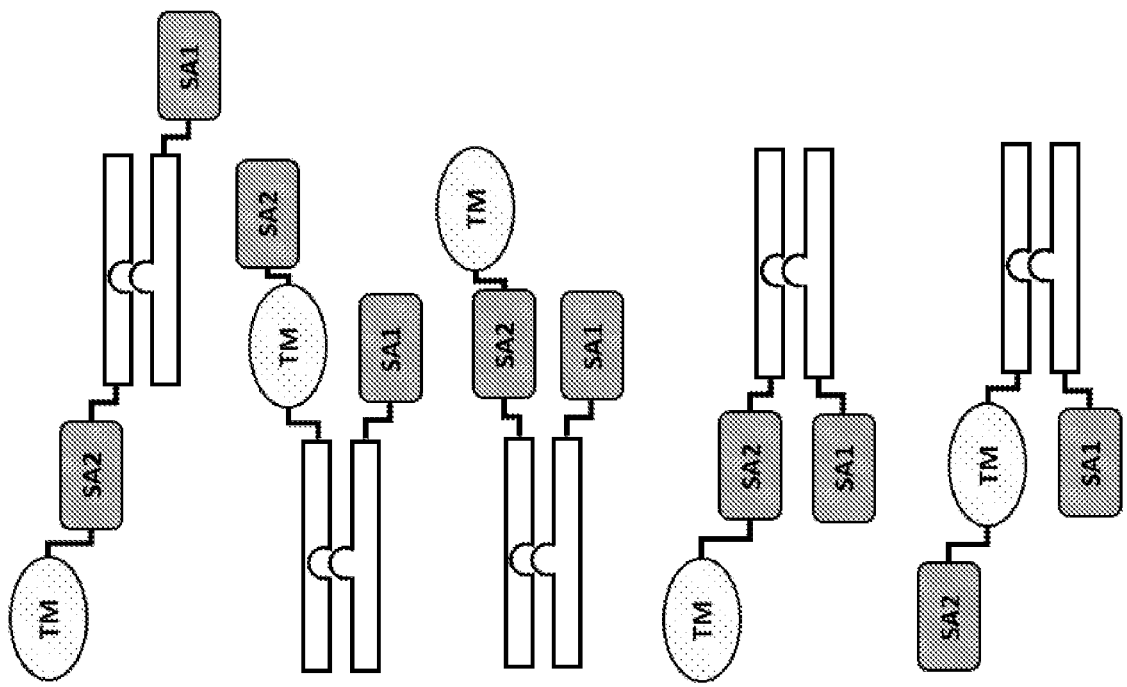
Figures 19A, 19B, 19C, 19D, 19E, 19F:
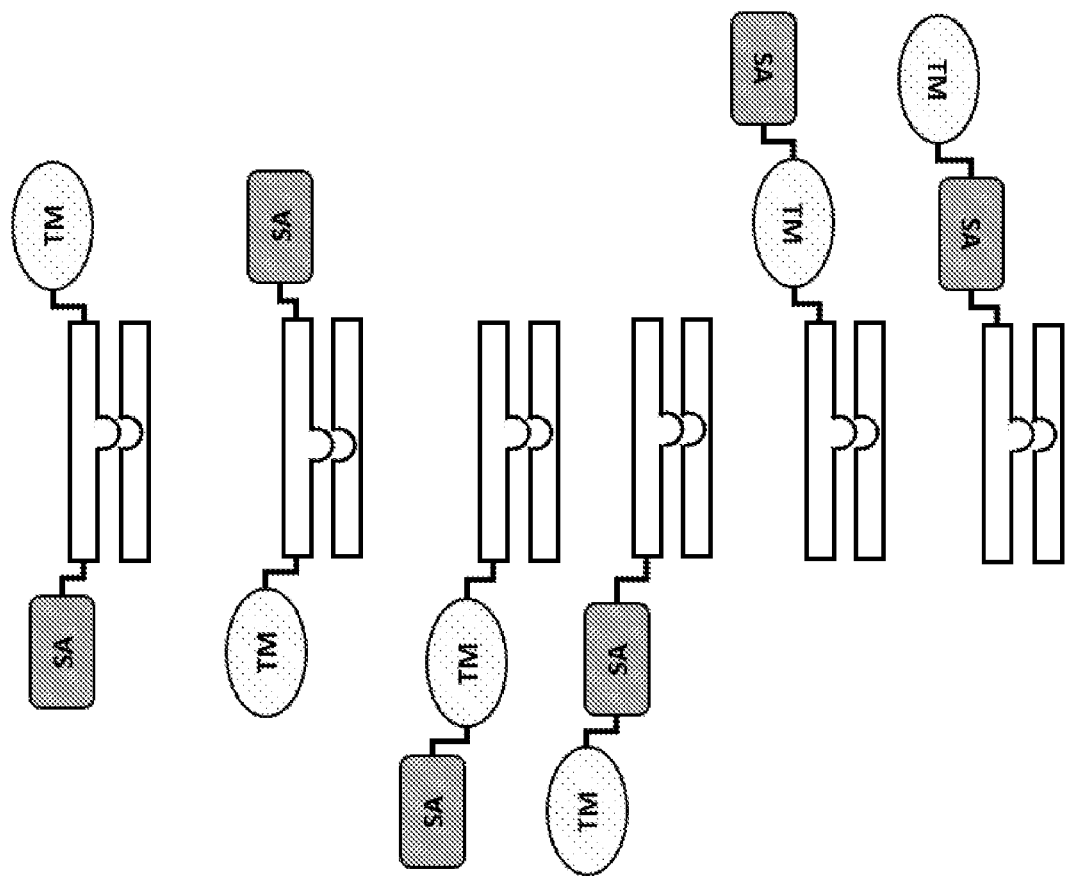
Figures 20F, 20G, 20H, 20I, 20J, 20K, 20L:
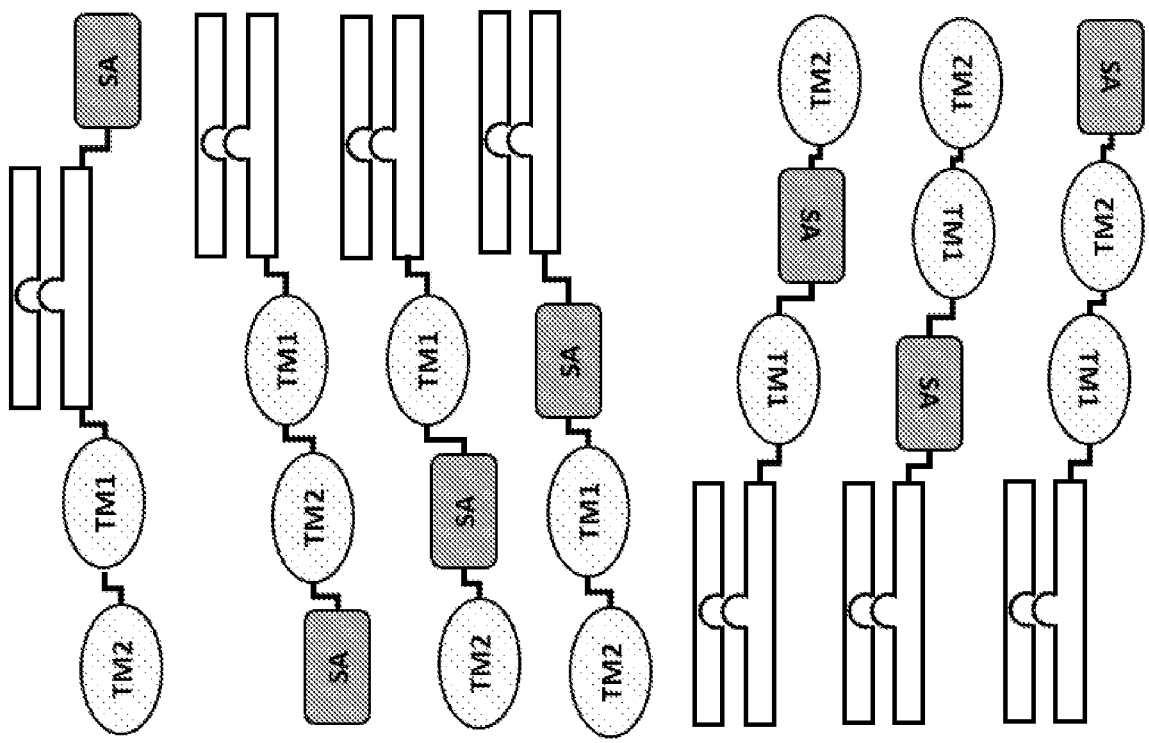
Figures 21A, 21B, 21C, 21D, 21E, 21F:
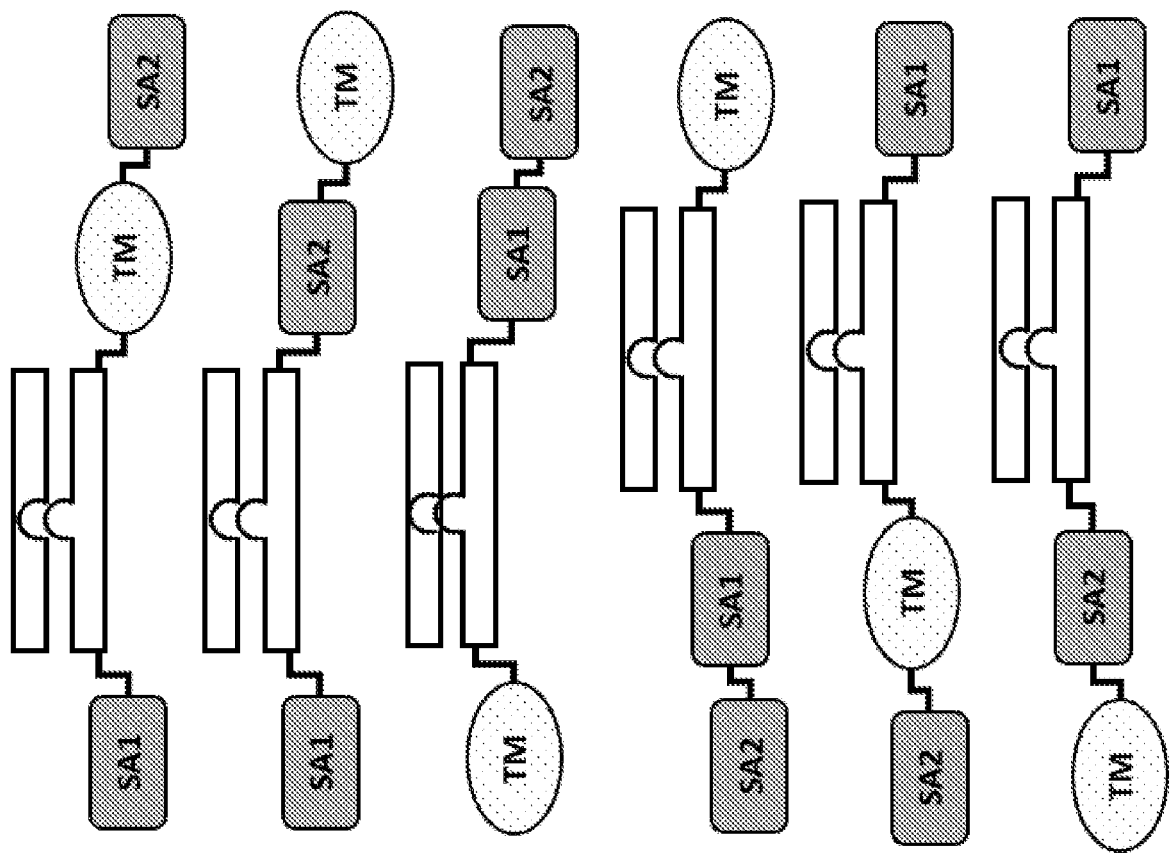
Figure 22A:
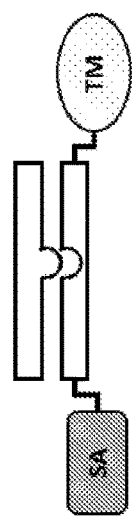
Figure 22B:
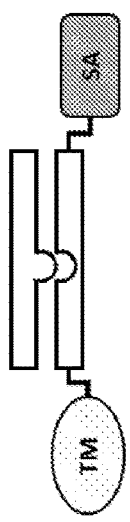
Figure 22C:
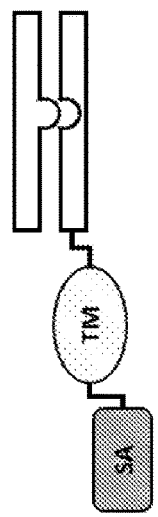
Figure 22D:
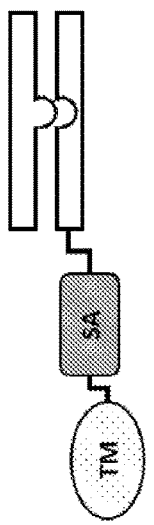
Figure 22E:
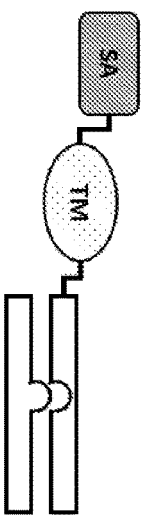
Figure 22F:
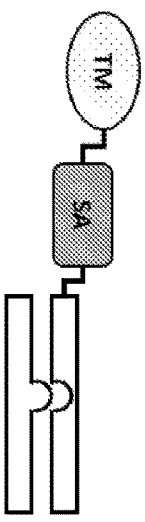
Figures 23A, 23B, 23C, 23D, 23E, 23F:
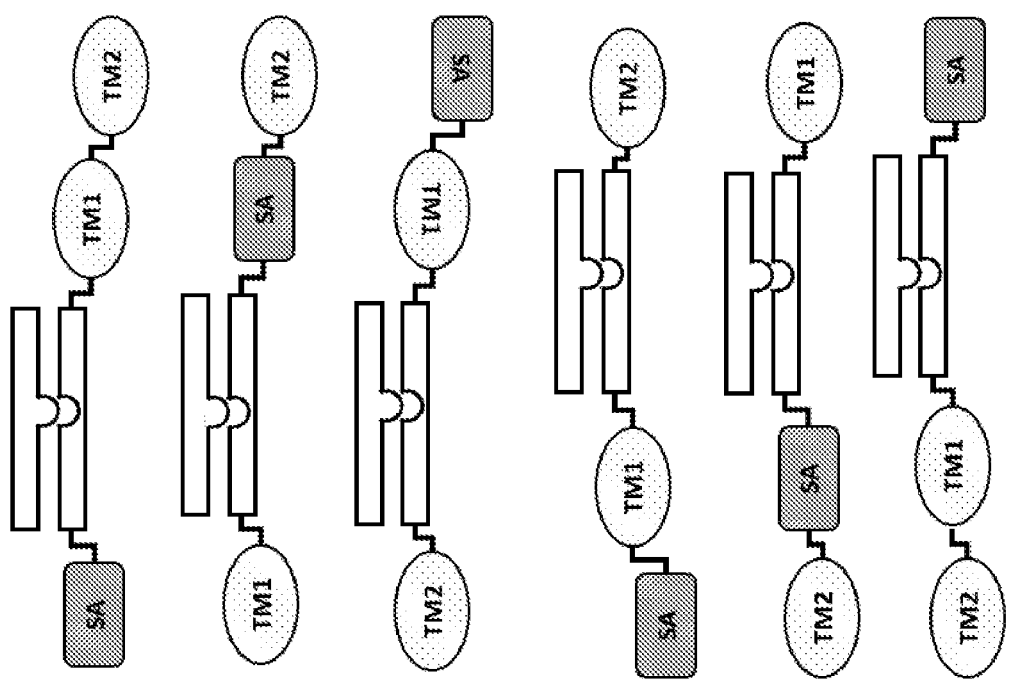
Figures 24A, 24B, 24C, 24D, 24E, 24F:
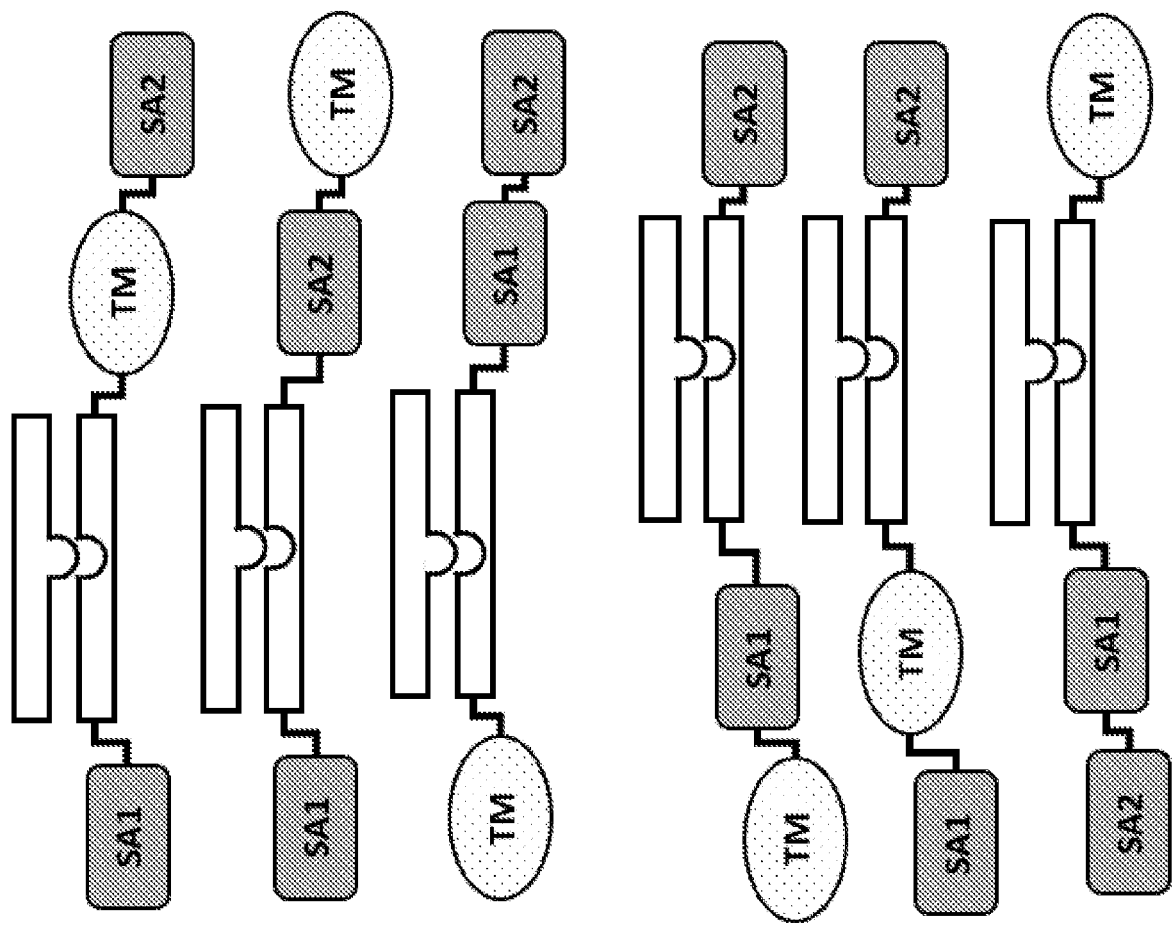
Figures 24G, 24H, 24I, 24J, 24K, 24L:
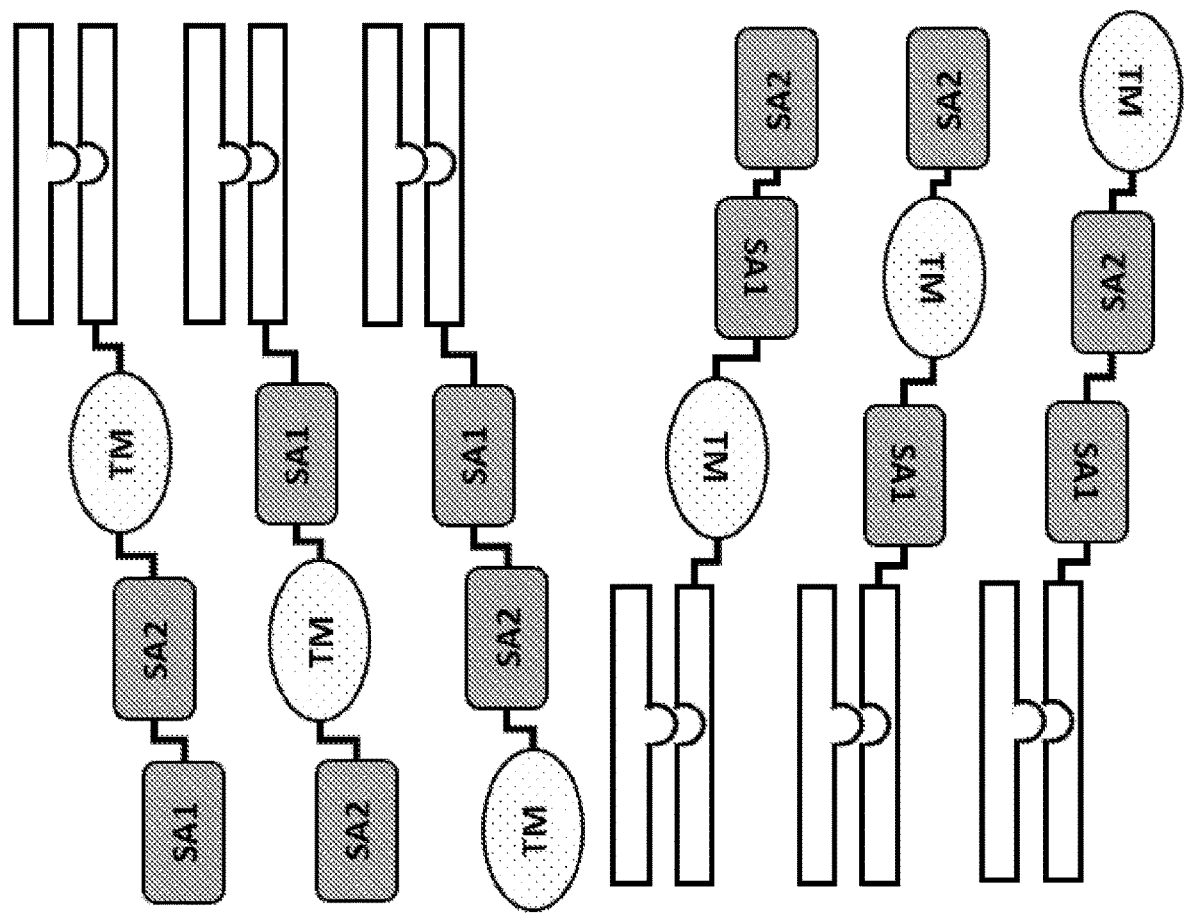
Figures 25A, 25B, 25C, 25D, 25E:
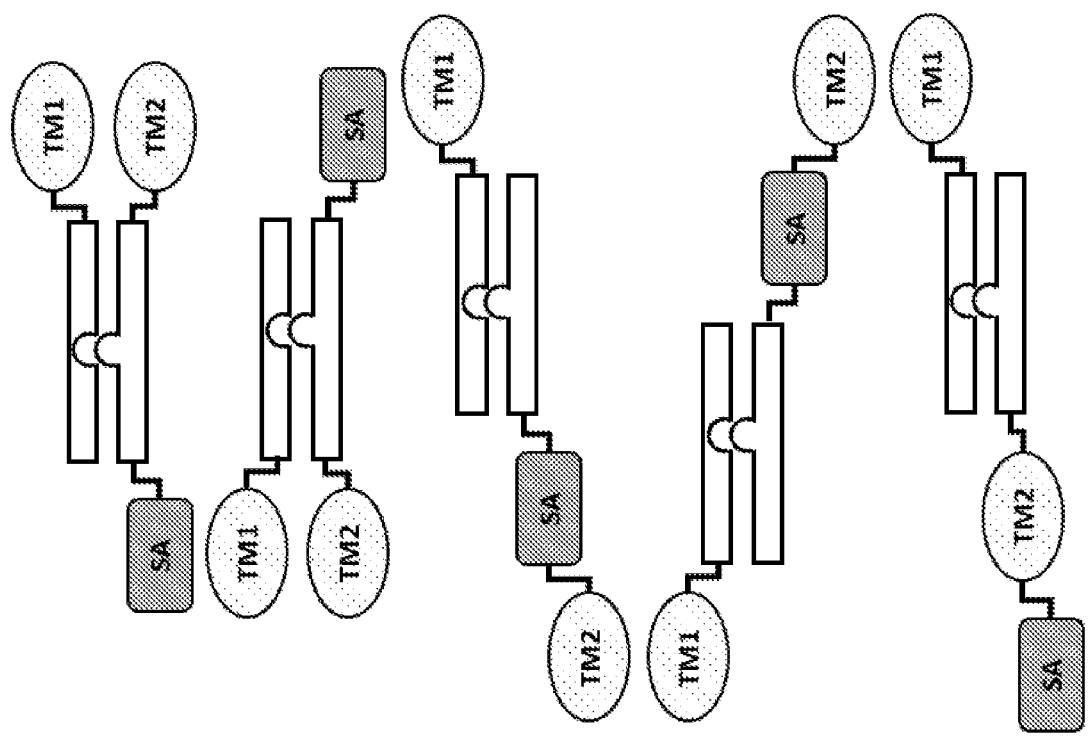
Figures 25F, 25G, 25H, 25I, 25J:
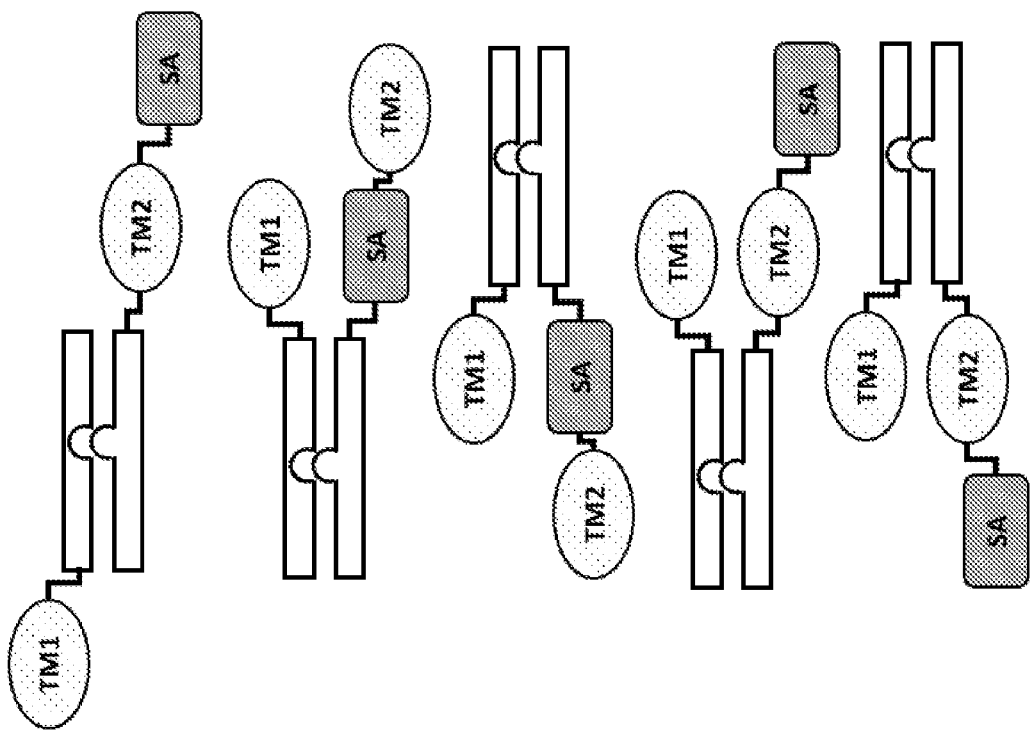
Figures 26A, 26B, 26C, 26D, 26E:
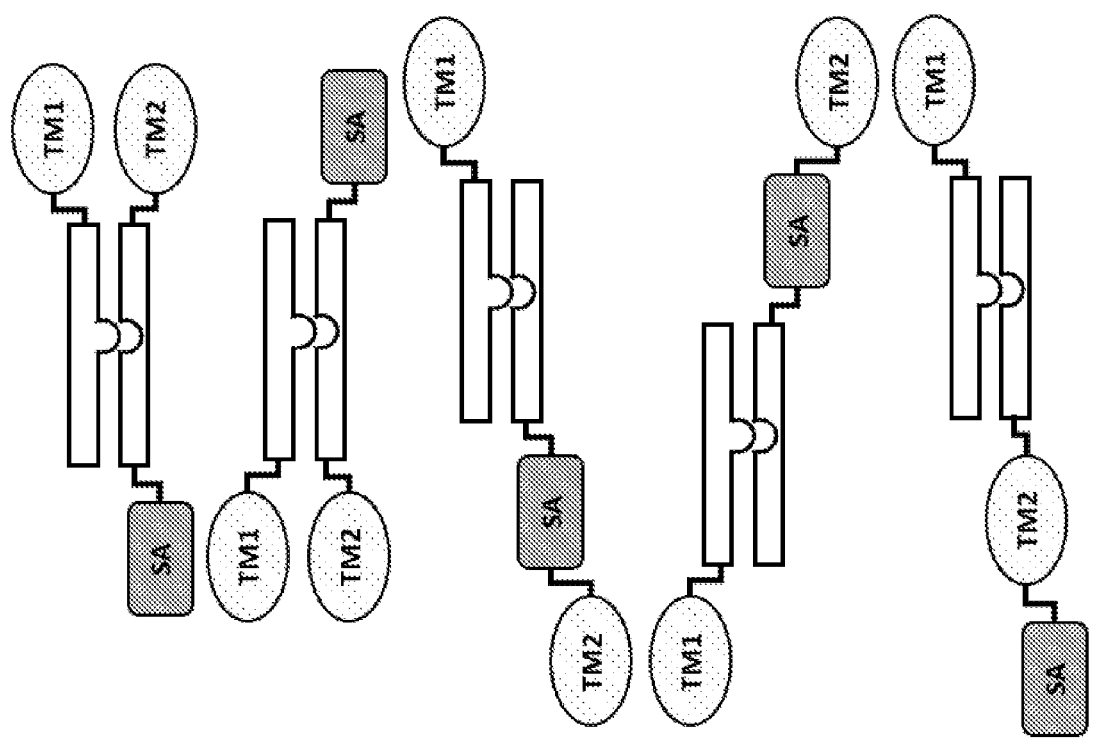
Figures 26F, 26G, 26H, 26I, 26J:
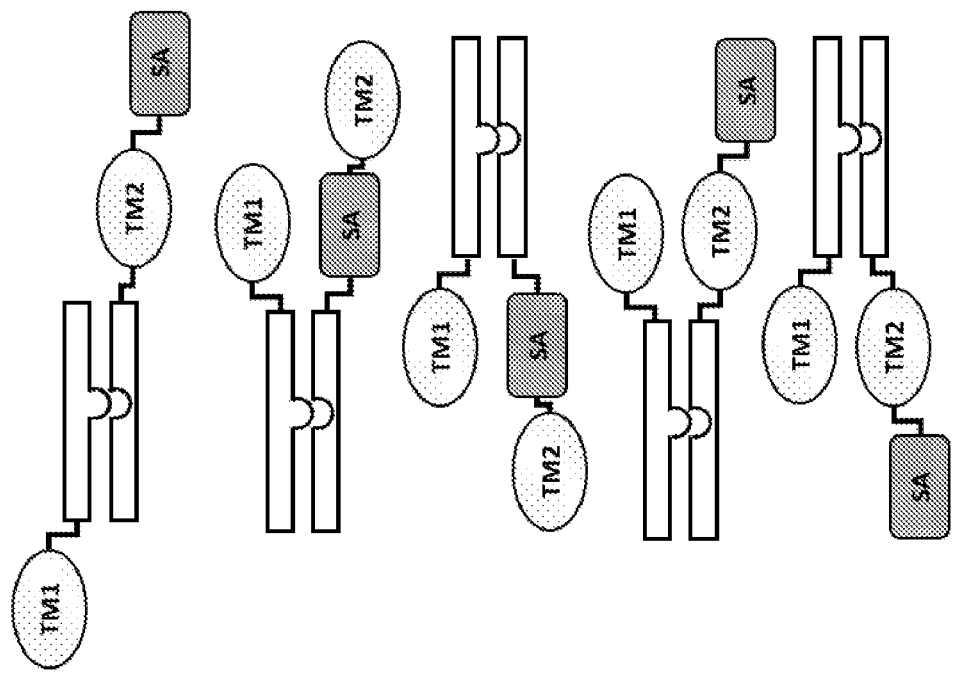
Figure 29A:
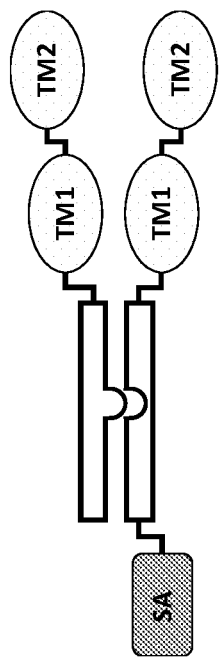
Figure 29B:
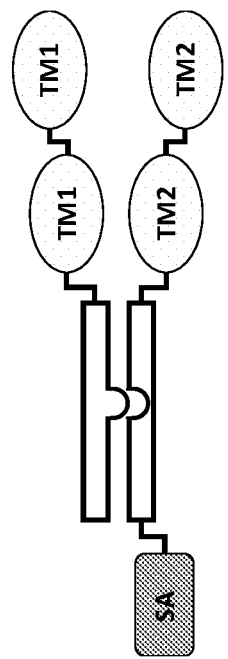
Figure 29C:
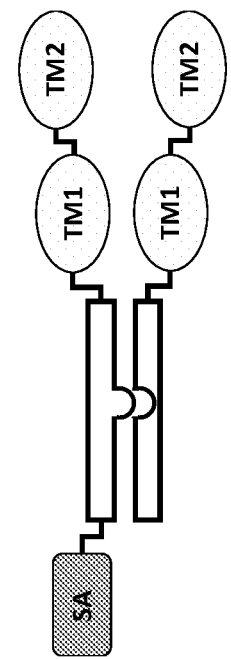
Figure 29D:
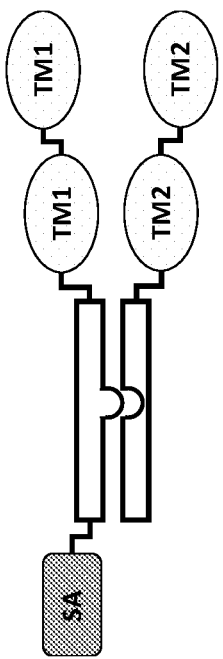

In some embodiments, the Fc-based chimeric protein complexes are a complex of proteins formed, for example, by disulfide bonding and/or ionic pairing. In embodiments, the complex of proteins includes one or more fusion proteins. In some embodiments, the Fc-based chimeric protein complex has a configuration and/or orientation/configuration as shown in any one of FIGS. 10A-F, 11A-H, 12A-H, 13A-D, 14A-F, 15A-J, 16A-D, 17A-F, 18A-J, 19A-F, 20A-L, 21A-L, 22A-F, 23A-L, 24A-L, 25A-J, 26A-J, 27A-F, 28A-F, and 29A-D. In some embodiments, the Fc-based chimeric protein complex has a configuration and/or orientation/configuration as shown in FIG. 16B.

The present technology provides pharmaceutical compositions comprising the Fc-based chimeric protein complexes and their use in the treatment of various diseases, including, e.g., cancer, autoimmune, neurodegenerative diseases, metabolic diseases, cardiovascular diseases and degenerative diseases.

Fc Domains

The fragment crystallizable domain (Fc domain) is the tail region of an antibody that interacts with Fc receptors located on the cell surface of cells that are involved in the immune system, e.g., B lymphocytes, dendritic cells, natural killer cells, macrophages, neutrophils, eosinophils, basophils, and mast cells. In IgG, IgA and IgD antibody isotypes, the Fc domain is composed of two identical protein chains, derived from the second and third constant domains of the antibody's two heavy chains. In IgM and IgE antibody isotypes, the Fc domain contains three heavy chain constant domains ($C_H$ domains 2-4) in each polypeptide chain.

In some embodiments, the Fc-based chimeric protein complex of the present technology include(s) chimeric proteins with Fc domains that promotes formation of such protein complexes. In some embodiments, the Fc domains are from selected from IgG, IgA, IgD, IgM, or IgE. In some embodiments, the Fc domains are from selected from IgG1, IgG2, IgG3, or IgG4.

In some embodiments, the Fc domains are from selected from human IgG, IgA, IgD, IgM, or IgE. In some embodiments, the Fc domains are from selected from human IgG1, IgG2, IgG3, or IgG4.

In some embodiments, the Fc domains of the Fc-based chimeric protein complex comprise the CH2 and CH3 regions of IgG. In some embodiments, the IgG is human IgG. In some embodiments, the human IgG is selected from IgG1, IgG2, IgG3, or IgG4.

In some embodiments, the Fc domains comprise one or more mutations. In some embodiments, the mutation(s) to the Fc domains reduces or eliminates the effector function the Fc domains. In some embodiments, the mutated Fc domain has reduced affinity or binding to a target receptor. By way of example, in some embodiments, the mutation to the Fc domains reduces or eliminates the binding of the Fc domains to FcγR. In some embodiments, the FcγR is selected from FcγRI; FcγRIIa, 131 R/R; FcγRIIa, 131 H/H, FcγRIIb; and FcγRIII. In some embodiments, the mutation to the Fc domains reduces or eliminated binding to complement proteins, such as, e.g., C1q. In some embodiments, the mutation to the Fc domains reduces or eliminated binding to both FcγR and complement proteins, such as, e.g., C1q.

In some embodiments, the Fc domains comprise the LALA mutation to reduce or eliminate the effector function of the Fc domains. By way of example, in some embodiments, the LALA mutation comprises L234A and L235A substitutions in human IgG (e.g., IgG1) (wherein the numbering is based on the commonly used numbering of the CH2 residues for human IgG1 according to EU convention (PNAS, Edelman et al., 1969; 63 (1) 78-85)).

In some embodiments, the Fc domains of human IgG comprise a mutation at one or more of L234, L235, K322, D265, P329, and P331 to reduce or eliminate the effector function of the Fc domains. By way of example, in some embodiments, the mutations are selected from L234A, L234F, L235A, L235E, L235Q, K322A, K322Q, D265A, P329G, P329A, P331G, and P331S.

In some embodiments, the Fc domains comprise the FALA mutation to reduce or eliminate the effector function of the Fc domains. By way of example, in some embodiments, the FALA mutation comprises F234A and L235A substitutions in human IgG4.

In some embodiments, the Fc domains of human IgG4 comprise a mutation at one or more of F234, L235, K322, D265, and P329 to reduce or eliminate the effector function of the Fc domains. By way of example, in some embodiments, the mutations are selected from F234A, L235A, L235E, L235Q, K322A, K322Q, D265A, P329G, and P329A.

In some embodiments, the mutation(s) to the Fc domain stabilize a hinge region in the Fc domain. By way of example, in some embodiments, the Fc domain comprises a mutation at S228 of human IgG to stabilize a hinge region. In some embodiments, the mutation is S228P.

In some embodiments, the mutation(s) to the Fc domain promote chain pairing in the Fc domain. In some embodiments, chain pairing is promoted by ionic pairing (a/k/a charged pairs, ionic bond, or charged residue pair).

In some embodiments, the Fc domain comprises a mutation at one more of the following amino acid residues of IgG to promote of ionic pairing: D356, E357, L368, K370, K392, D399, and K409.

By way of example, in some embodiments, the human IgG Fc domain comprise one of the mutation combinations in Table 1 to promote of ionic pairing.

TABLE 1

| Substitution(s) on one Fc Chain | Substitution(s) on other Fc Chain |
| --- | --- |
| D356K D399K | K392D K409D |
| E357R L368R | K370D K409D |
| E357R L368K | K370D K409D |
| E357R D399K | K370D K409D |
| E357R | K370D |
| L368R D399K | K392D K409D |
| L368K D399K | K392D K409D |
| L368R D399K | K409D |
| L368K D399K | K409D |
| L368R | K409D |
| L368K | K409D |
| K370D K409D | E357R D399K |
| K370D K409D | E357R L368R |

TABLE 1-continued

| Substitution(s) on one Fc Chain | Substitution(s) on other Fc Chain |
| --- | --- |
| K370D K409D | E357R L368K |
| K370D K409D | E357R D399K |
| K370D K409D | E357R L368R |
| K370D K409D | E357R L368K |
| K370D | E357R |
| K370D | E357R |
| K392D K409D | D356K D399K |
| K392D K409D | L368R D399K |
| K392D K409D | L368K D399K |
| K392D K409D | D399K |
| D399K | K392D K409D |
| D399K | K409D |
| K409D | L368R |
| K409D | L368K |
| K409D | L368R D399K |
| K409D | L368K D399K |
| K409D | L368R |
| K409D | L368K |
| K409D | L368R D399K |
| K409D | L368K D399K |
| K409D | D399K |

In some embodiments, chain pairing of the individual Fc-domains in a chimeric protein complex is promoted by knob-in-hole mutations. In some embodiments, the Fc domain comprises one or more mutations to allow for a knob-in-hole interaction in the Fc domain. In some embodiments, a first Fc chain is engineered to express the "knob" and a second Fc chain is engineered to express the complementary "hole." By way of example, in some embodiments, human IgG Fc domain comprises the mutations of Table 2 to allow for a knob-in-hole interaction.

TABLE 2

| Substitution(s) on one Fc Chain | Substitution(s) on other Fc Chain |
| --- | --- |
| T366Y | Y407T |
| T366Y/F405A | T394W/Y407T |
| T366W | Y407A |
| T366W | Y407V |
| T366Y | Y407A |
| T366Y | Y407V |
| T366Y | Y407T |

In some embodiments, the Fc domains in the Fc-based chimeric protein complexes of the present technology comprise any combination of the above-disclosed mutations. By way of example, in some embodiments, the Fc domain comprises mutations that promote ionic pairing and/or a knob-in-hole interaction. By way of example, in some embodiments, the Fc domain comprises mutations that have one or more of the following properties: promote ionic pairing, induce a knob-in-hole interaction, reduce or eliminate the effector function of the Fc domain, and cause Fc stabilization (e.g. at hinge).

By way of example, in some embodiments, a human IgG Fc domain comprise mutations disclosed in Table 3, which promote ionic pairing and/or promote a knob-in-hole interaction in the Fc domain.

TABLE 3

| Substitution(s) on one Fc Chain | Substitution(s) on other Fc Chain |
| --- | --- |
| T366W K370D | E357R Y407A |
| T366W K370D | E357R Y407V |
| T366W K409D | L368R Y407A |
| T366W K409D | L368R Y407V |

TABLE 3-continued

| Substitution(s) on one Fc Chain | Substitution(s) on other Fc Chain |
|---|---|
| T366W K409D | L368K Y407A |
| T366W K409D | L368K Y407V |
| T366W K409D | L368R D399K Y407A |
| T366W K409D | L368R D399K Y407V |
| T366W K409D | L368K D399K Y407A |
| T366W K409D | L368K D399K Y407V |
| T366W K409D | D399K Y407A |
| T366W K409D | D399K Y407V |
| T366W K392D K409D | D399K Y407A |
| T366W K392D K409D | D399K Y407V |
| T366W K392D K409D | D356K D399K Y407A |
| T366W K392D K409D | D356K D399K Y407V |
| T366W K370D K409D | E357␣D399K Y407A |
| T366W K370D K409D | E357␣D399K Y407V |
| T366W K370D K409D | E357R L368R Y407A |
| T366W K370D K409D | E357R L368R Y407V |
| T366W K370D K409D | E357R L368K Y407A |
| T366W K370D K409D | E357R L368K Y407V |
| T366W K392D K409D | L368R D399K Y407A |
| T366W K392D K409D | L368R D399K Y407V |
| T366W K392D K409D | L368K D399K Y407A |
| T366W K392D K409D | L368K D399K Y407V |
| E357R T366W | K370D Y407A |
| E357R T366W | K370D Y407V |
| T366W L368R | Y407A K409D |
| T366W L368R | Y407V K409D |
| T366W L368K | Y407A K409D |
| T366W L368K | Y407V K409D |
| T366W L368R D399K | Y407A K409D |
| T366W L368R D399K | Y407V K409D |
| T366W L368K D399K | Y407A K409D |
| T366W L368K D399K | Y407V K409D |
| T366W D399K | Y407A K409D |
| T366W D399K | Y407V K409D |
| T366W D399K | K392D Y407A K409D |
| T366W D399K | K392D Y407V K409D |
| T366W D356K D399K | K392D Y407A K409D |
| T366W D356K D399K | K392D Y407V K409D |
| E357R T366W D399K | K370D Y407A K409D |
| E357R T366W D399K | K370D Y407V K409D |
| E357R T366W L368R | K370D Y407A K409D |
| E357R T366W L368R | K370D Y407V K409D |
| E357R T366W L368K | K370D Y407A K409D |
| E357R T366W L368K | K370D Y407V K409D |
| T366W L368R D399K | K392D Y407A K409D |
| T366W L368R D399K | K392D Y407V K409D |
| T366W L368K D399K | K392D Y407A K409D |

By way of example, in some embodiments, human IgG Fc domains comprise mutations disclosed in Table 4, which promote ionic pairing, promote a knob-in-hole interaction, or a combination thereof of the Fc domains. In embodiments, the "Chain 1" and "Chain 2" of Table 4 can be interchanged (e.g. Chain 1 can have Y407T and Chain 2 can have T366Y).

TABLE 4

| Chain 1 mutation | Chain 2 mutation | Reference | IgG |
|---|---|---|---|
| T366Y | Y407T | Ridgway et al., 1996 Protein Engineering, Design and Selection, Volume 9, Issue 7, 1 Jul. 1996, Pages 617-62 | IgG1 |
| T366Y/F405A | T394W/Y407T | Ridgway et al., 1996 Protein Engineering, Design and Selection, Volume 9, Issue 7, 1 Jul. 1996, Pages 617-62 | IgG1 |
| T366W | Y407A | Atwell et al., 1997 JMB Volume 270, Issue 1, 4 Jul. 1997, Pages 26-35 | IgG1 |
| T366W | T366S/L368V/Y407A | Atwell et al., 1997 JMB Volume 270, Issue 1, 4 Jul. 1997, Pages 26-35 | IgG1 |
| T366W | L368A/Y407A | Atwell et al., 1997 JMB Volume 270, Issue 1, 4 Jul. 1997, Pages 26-35 | IgG1 |
| T366W | T366S/L368A/Y407A | Atwell et al., 1997 JMB Volume 270, Issue 1, 4 Jul. 1997, Pages 26-35 | IgG1 |
| T366W | T366S/L368G/Y407V | Atwell et al., 1997 JMB Volume 270, Issue 1, 4 Jul. 1997, Pages 26-35 | IgG1 |
| T366W/D399C | T366S/L368A/K392C/Y407V | Merchant et al., 1998 Nature Biotechnology volume 16, pages 677-681 (1998) | IgG1 |
| T366W/K392C | T366S/L368A/D399C/Y407V | Merchant et al., 1998 Nature Biotechnology volume 16, pages 677-681 (1998) | IgG1 |
| S354C/T366W | Y349C/T366S/L368A/Y407V | Merchant et al., 1998 Nature Biotechnology volume 16, pages 677-681 (1998) | IgG1 |
| Y349C/T366W | S354C/T366S/L368A/Y407V | Merchant et al., 1998 Nature Biotechnology volume 16, pages 677-681 (1998) | IgG1 |
| E356C/T366W | Y349C/T366S/L368A/Y407V | Merchant et al., 1998 Nature Biotechnology volume 16, pages 677-681 (1998) | IgG1 |
| Y349C/T366W | E356C/T366S/L368A/Y407V | Merchant et al., 1998 Nature Biotechnology volume 16, pages 677-681 (1998) | IgG1 |

TABLE 4-continued

| Chain 1 mutation | Chain 2 mutation | Reference | IgG |
|---|---|---|---|
| E357C/T366W | Y349C/T366S/L368A/Y407V | Merchant et al., 1998 Nature Biotechnology volume 16, pages 677-681 (1998) | IgG1 |
| Y349C/T366W | E357C/T366S/L368A/Y407V | Merchant et al., 1998 Nature Biotechnology volume 16, pages 677-681 (1998) | IgG1 |
| D339R | K409E | Gunasekaran et al., 2010 The Journal of Biological Chemistry 285, 19637-19646. | IgG1 |
| D339K | K409E | Gunasekaran et al., 2010 The Journal of Biological Chemistry 285, 19637-19646. | IgG1 |
| D339R | K409D | Gunasekaran et al., 2010 The Journal of Biological Chemistry 285, 19637-19646. | IgG1 |
| D339K | K409D | Gunasekaran et al., 2010 The Journal of Biological Chemistry 285, 19637-19646. | IgG1 |
| D339K | K360D/K409E | Gunasekaran et al., 2010 The Journal of Biological Chemistry 285, 19637-19646. | IgG1 |
| D339K | K392D/K409E | Gunasekaran et al., 2010 The Journal of Biological Chemistry 285, 19637-19646. | IgG1 |
| D339K/E356K | K392D/K409E | Gunasekaran et al., 2010 The Journal of Biological Chemistry 285, 19637-19646. | IgG1 |
| D339K/E357K | K392D/K409E | Gunasekaran et al., 2010 The Journal of Biological Chemistry 285, 19637-19646. | IgG1 |
| D339K/E356K | K409E/K439D | Gunasekaran et al., 2010 The Journal of Biological Chemistry 285, 19637-19646. | IgG1 |
| D339K/E357K | K370D/K409E | Gunasekaran et al., 2010 The Journal of Biological Chemistry 285, 19637-19646. | IgG1 |
| D339K/E356K/E357K | K370D/K392D/K409E | Gunasekaran et al., 2010 The Journal of Biological Chemistry 285, 19637-19646. | IgG1 |
| S364H/F405A | Y349T/T394F | Moore et al., 2011 mAbs, 3: 6, 546-557 | IgG1 |
| S364H/T394F | Y349T/F405A | Moore et al., 2011 mAbs, 3: 6, 546-557 | IgG1 |
| D221R/P228R/K409R | D221E/P228E/L368E | Strop et al., 2012 JMB Volume 420, Issue 3, 13 Jul. 2012, Pages 204-219 | IgG1 |
| C223R/E225R/P228R/K409R | C223E/P228E/L368E | Strop et al., 2012 JMB Volume 420, Issue 3, 13 Jul. 2012, Pages 204-219 | IgG2 |
| F405L | K409R | Labrijn et al., 2013 PNAS Mar. 26, 2013, 110 (13) 5145-5150 | IgG1 |
| F405A/Y407V | T394W | Von Kreudenstein et al., 2013 mAbs Volume 5, 2013 - Issue 5, pp. 644-654 | IgG1 |
| F405A/Y407V | T366I/T394W | Von Kreudenstein et al., 2013 mAbs Volume 5, 2013 - Issue 5, pp.644-654 | IgG1 |
| F405A/Y407V | T366L/T394W | Von Kreudenstein et al., 2013 mAbs Volume 5, 2013 - Issue 5, pp. 644-654 | IgG1 |
| F405A/Y407V | T366L/K392M/T394W | Von Kreudenstein et al., 2013 mAbs Volume 5, 2013 - Issue 5, pp. 644-654 | IgG1 |
| L351Y/F405A/Y407V | T366L/K392M/T394W | Von Kreudenstein et al., 2013 mAbs Volume 5, 2013 - Issue 5, pp. 644-654 | IgG1 |
| T350V/L351Y/F405A/Y407V | T350V/T366L/K392M/T394W | Von Kreudenstein et al., 2013 mAbs Volume 5, 2013 - Issue 5, pp. 644-654 | IgG1 |
| T350V/L351Y/F405A/Y407V | T350V/T366L/K392L/T394W | Von Kreudenstein et al., 2013 mAbs Volume 5, 2013 - Issue 5, pp. 644-654 | IgG1 |
| K409W | D339V/F405T | Choi et al., 2013 PNAS Jan. 2, 2013. 110 (1) 270-275 | IgG1 |
| K360E | Q347R | Choi et al., 2013 PNAS Jan. 2, 2013. 110 (1) 270-275 | IgG1 |
| K360E/K409W | D339V/Q347R/F405T | Choi et al., 2013 PNAS Jan. 2, 2013. 110 (1) 270-275 | IgG1 |
| Y349C/K360E/K409W | D339V/Q347R/S354C/F405T | Choi et al., 2013 PNAS Jan. 2, 2013. 110 (1) 270-275 | IgG1 |
| K392A/K409D | E356K/D399K | Leaver-Fey et al., 2016 Structure Volume 24, Issue 4, 5 April 2016, Pages 641-651 | IgG1 |
| T366W | T366S/L358A/Y407A | Leaver-Fey et al., 2016 Structure Volume 24, Issue 4, 5 April 2016, Pages 641-651 | IgG1 |
| D339M/Y407A | T336V/K409V | Leaver-Fey et al., 2016 Structure Volume 24, Issue 4, 5 April 2016, Pages 641-651 | IgG1 |
| D339M/K360D/Y407A | T336V/E345R/Q347R/K409V | Leaver-Fey et al., 2016 Structure Volume 24, Issue 4, 5 April 2016, Pages 641-651 | IgG1 |
| Y349S/T366V/K370Y/K409V | E357D/S364Q/Y407A | Leaver-Fey et al., 2016 Structure Volume 24, Issue 4, 5 April 2016, Pages 641-651 | IgG1 |
| Y349S/T366M/K370Y/K409V | E356G/E357D/S364Q/Y407A | Leaver-Fey et al., 2016 Structure Volume 24, Issue 4,5 April 2016, Pages 641-651 | IgG1 |

TABLE 4-continued

| Chain 1 mutation | Chain 2 mutation | Reference | IgG |
|---|---|---|---|
| Y349S/T366M/K370Y/K409V | E357D/S364R/Y407A | Leaver-Fey et al., 2016 Structure Volume 24, Issue 4, 5 April 2016, Pages 641-651 | IgG1 |

And any combination as described in Tables 1-3 of US20150284475A1

By way of example, in some embodiments, a human IgG Fc domains comprise mutations disclosed in Table 5, which reduce or eliminate FcγR and/or complement binding in the Fc domain. In embodiments, the table 5 mutations are in both chains.

TABLE 5

| Chain 1 mutation | Reference | IgG |
|---|---|---|
| L234A/L235A | Alegre et al., 1994 Transplantation 57: 1537-1543 | IgG1 |
| F234A/L235A | Alegre et al., 1994 Transplantation 57: 1537-1543 | IgG4 |
| L235E | Morgan et al., 1995 Immunology. 1995 October 86(2): 319-324. | IgG1 |
| L235E | Morgan et al., 1995 Immunology. 1995 October 86(2): 319-324. | IgG4 |
| L235A | Morgan et al., 1995 Immunology. 1995 October 86(2): 319-324. | IgG1 |
| G237A | Morgan et al., 1995 Immunology. 1995 October 86(2): 319-324. | IgG1 |
| N297H | Tao and Morrison, J. Immunol. 1989; 143: 2595-2601 | IgG1 |
| N297Q | Tao and Morrison, J. Immunol. 1989; 143: 2595-2601 | IgG1 |
| N297K | Tao and Morrison, J. Immunol. 1989; 143: 2595-2601 | IgG3 |
| N297Q | Tao and Morrison, J. Immunol. 1989; 143: 2595-2601 | IgG3 |
| D265A | Idusogie et al., 2000 J Immunol Apr. 15, 2000, 164 (8) 4178-4184 | IgG1 |
| D270A, V, K | Idusogie et al., 2000 J Immunol Apr. 15, 2000, 164 (8) 4178-4184 | IgG1 |
| K322A, L, M, D, E | Idusogie et al., 2000 J Immunol Apr. 15, 2000, 164 (8) 4178-4184 | IgG1 |
| P329A, X | Idusogie et al., 2000 J Immunol Apr. 15, 2000, 164 (8) 4178-4184 | IgG1 |
| P331A, S, G, X | Idusogie et al., 2000 J Immunol Apr. 15, 2000, 164 (8) 4178-4184 | IgG1 |
| D265A | Idusogie et al., 2000 J Immunol Apr. 15, 2000, 164 (8) 4178-4184 | IgG1 |
| L234A | Hezareh et al., 2001 J. Virol. December 2001 vol. 75 no. 24 12161-12168 | IgG1 |
| L234A/L235A | Hezareh et al., 2001 J. Virol. December 2001 vol. 75 no. 24 12161-12168 | IgG1 |
| L234F/L235E/P331S | Oganesyan et al., 2008 Acta Cryst. (2008). D64, 700-704 | IgG1 |
| H268Q/V309L/A330S/P331S | An et al., 2009 mAbs Volume 1, 2009 - Issue 6, pp. 572-579 | IgG1 |
| G236R/L328R | Moore et al., 2011 mAbs Volume 3, 2011 - Issue 6, pp. 546-557 | IgG1 |
| N297G | Couch et al., 2013 Sci. Transl. Med., 5 (2013) 183ra57, 1-12 | IgG1 |
| N297G/D265A | Couch et al., 2013 Sci. Transl. Med., 5 (2013) 183ra57, 1-12 | IgG1 |
| V234A/G237A/P328S/H268A/V309L/A330S/P331S | Vafa et al., 2014 Methods Volume 65, Issue 1, 1 Jan. 2014, Pages 114-126 | IgG2 |
| L234A/L235A/P329G | Lo et al., 2016 The Journal of Biological Chemistry 292, 3900-3908 | IgG1 |
| N297D | Schlothauer et al., 2016 Protein Engineering, Design and Selection, Volume 29, Issue 10, 1 Oct. 2016, Pages 457-466 | IgG1 |
| S228P/L235E | Schlothauer et al., 2016 Protein Engineering, Design and Selection, Volume 29, Issue 10, 1 Oct. 2016, Pages 457-466 | IgG4 |
| S228P/L235E/P329G | Schlothauer et al., 2016 Protein Engineering, Design and Selection, Volume 29, Issue 10, 1 Oct. 2016, Pages 457-466 | IgG4 |
| L234F/L235A/K322Q | Borrok et al., 2017 J Pharm Sci April 2017 Volume 106, Issue 4, Pages 1008-1017 | IgG1 |
| L234F/L235Q/P331G | Borrok et al., 2017 J Pharm Sci April 2017 Volume 106, Issue 4, Pages 1008-1017 | IgG1 |
| L234F/L235Q/K322Q | Borrok et al., 2017 J Pharm Sci April 2017 Volume 106, Issue 4, Pages 1008-1017 | IgG1 |
| L234A/L235A/G237A/P328S/H268A/A330S/P331S | Tam et al., 2017 Open Access Antibodies 2017, 6(3), 12; doi: 10.3390/antib6030012 | IgG1 |
| S228P/F234A/L235A | Tam et al., 2017 Open Access Antibodies 2017, 6(3), 12; doi: 10.3390/antib6030012 | IgG4 |
| S228P/F234A/L235A/G237A/P238S | Tam et al., 2017 Open Access Antibodies 2017, 6(3), 12; doi: 10.3390/antib6030012 | IgG4 |
| S228P/F234A/L235A/G236B/G237A/P238S | Tam et al., 2017 Open Access Antibodies 2017, 6(3), 12; doi: 10.3390/antib6030012 | IgG4 |

In some embodiments, the Fc domains in the Fc-based chimeric protein complexes of the present technology are homodimeric, i.e., the Fc domain in the chimeric protein complex comprises two identical protein chains.

In some embodiments, the Fc domains in the Fc-based chimeric protein complexes of the present technology are heterodimeric, i.e., the Fc domain in the chimeric protein complex comprises two non-identical protein chains.

In some embodiments, heterodimeric Fc domains are engineered using ionic pairing and/or knob-in-hole mutations described herein. In some embodiments, the heterodimeric Fc-based chimeric protein complexes have a trans orientation/configuration. In a trans orientation/configuration, the targeting moiety and signaling agent are, in embodiments, not found on the same polypeptide chain in the present Fc-based chimeric protein complexes. In some embodiments, the signaling agent and targeting moiety are on the same end (N-terminus or C-terminus) of the Fc domain. In some embodiments, the signaling agent and targeting moiety are on different ends (N-terminus or C-terminus) of the Fc domain.

In some embodiments, heterodimeric Fc domains are engineered using ionic pairing and/or knob-in-hole mutations described herein. In some embodiments, the heterodimeric Fc-based chimeric protein complexes have a trans orientation.

In a trans orientation, the targeting moiety and signaling agent are, in embodiments, not found on the same polypeptide chain in the present Fc-based chimeric protein complexes. In a trans orientation, the targeting moiety and signaling agent are, in embodiments, found on separate polypeptide chains in the Fc-based chimeric protein complexes. In a cis orientation, the targeting moiety and signaling agent are, in embodiments, found on the same polypeptide chain in the Fc-based chimeric protein complexes.

In some embodiments, where more than one targeting moiety is present in the heterodimeric protein complexes described herein, one targeting moiety may be in trans orientation (relative to the signaling agent), whereas another targeting moiety may be in cis orientation (relative to the signaling agent). In some embodiments, the signaling agent and target moiety are on the same ends/sides (N-terminal or C-terminal ends) of an Fc domain. In some embodiments, the signaling agent and targeting moiety are on different sides/ends of an Fc domain (N-terminal and C-terminal ends).

In some embodiments, where more than one targeting moiety is present in the heterodimeric protein complexes described herein, the targeting moieties may be found on the same Fc chain or on two different Fc chains in the heterodimeric protein complex (in the latter case the targeting moieties would be in trans relative to each other, as they are on different Fc chains). In some embodiments, where more than one targeting moiety is present on the same Fc chain, the targeting moieties may be on the same or different sides/ends of an Fc chain (N-terminal or/and C-terminal ends).

In some embodiments, where more than one signaling agent is present in the heterodimeric protein complexes described herein, the signaling agents may be found on the same Fc chain or on two different Fc chains in the heterodimeric protein complex (in the latter case the signaling agents would be in trans relative to each other, as they are on different Fc chains). In some embodiments, where more than one signaling agent is present on the same Fc chain, the signaling agents may be on the same or different sides/ends of an Fc chain (N-terminal or/and C-terminal ends).

In some embodiments, where more than one signaling agent is present in the heterodimeric protein complexes described herein, one signaling agent may be in trans orientation (as relates to the targeting moiety), whereas another signaling agent may be in cis orientation (as relates to the targeting moiety).

In some embodiments, the Fc domains include or start with the core hinge region of wild-type human IgG1, which contains the sequence Cys-Pro-Pro-Cys (SEQ ID NO: 1457). In some embodiments, the Fc domains also include the upper hinge, or parts thereof (e.g., DKTHTCPPC (SEQ ID NO: 1458; see WO2009053368), EPKSCDKTHTCPPC (SEQ ID NO: 1459), or EPKSSDKTHTCPPC (SEQ ID NO: 1460; see Lo et al., Protein Engineering vol. 11 no. 6 pp. 495-500, 1998)).

Fc-Based Chimeric Protein Complexes

In embodiments, the Fc-based chimeric protein complexes of the present technology comprise at least one Fc domain disclosed herein, at least one signaling agent (SA) disclosed herein, and at least one targeting moiety (TM) disclosed herein.

It is understood that, the present Fc-based chimeric protein complexes may encompass a complex of two fusion proteins.

In some embodiments, the Fc-based chimeric protein complex is heterodimeric. In some embodiments, the heterodimeric Fc-based chimeric protein complex has a trans orientation/configuration. In some embodiments, the heterodimeric Fc-based chimeric protein complex has a cis orientation/configuration. In some embodiments, the heterodimeric Fc-based chimeric protein complex does not comprise the signaling agent and targeting moiety on a single polypeptide. In some embodiments, the signaling agent and targeting moiety are on the same end (N-terminus or C-terminus) of the Fc domain or the Fc chains thereof. In some embodiments, the signaling agent and targeting moiety are on different ends (N-terminus or C-terminus) of the Fc domain or the Fc chains thereof.

In some embodiments, the Fc-based chimeric protein has an improved in vivo half-life relative to a chimeric protein lacking an Fc or a chimeric protein which is not a heterodimeric complex. In some embodiments, the Fc-based chimeric protein has an improved solubility, stability and other pharmacological properties relative to a chimeric protein lacking an Fc or a chimeric protein which is not a heterodimeric complex.

Heterodimeric Fc-based chimeric protein complexes are composed of two different polypeptides. In embodiments described herein, the targeting domain is on a different polypeptide than the signaling agent and accordingly, proteins that contain only one targeting domain copy, and also only one signaling agent copy can be made (this provides a configuration in which potential interference with desired properties can be controlled). Further, in embodiments, one targeting domain (e.g. VHH) only can avoid cross-linking of the antigen on the cell surface (which could elicit undesired effects in some cases) Further, in embodiments, one signaling agent may alleviate molecular "crowding" and potential interference with avidity mediated restoration of effector function in dependence of the targeting domain. Further, in embodiments, heterodimeric Fc-based chimeric protein complexes can have two targeting moieties and these can be placed on the two different polypeptides. For instance, in embodiments, the C-terminus of both targeting moieties (e.g. VHHs) can be masked to avoid potential autoantibodies or pre-existing antibodies (e.g. VHH autoantibodies or pre-existing antibodies). Further, in embodiments, heterodimeric Fc-based chimeric protein complexes, e.g. with the targeting domain on a different polypeptide than the signaling agent (e.g. wild type signaling agent), may favor "cross-linking" of two cell types (e.g. a tumor cell and an immune cell). Further, in embodiments, heterodimeric Fc-based chimeric protein complexes can have two signaling agents, each on different polypeptides to allow more complex effector responses (e.g. with any two of the signaling agents described herein, by way of illustration IFN alpha2 and TNF).

Further, in embodiments, heterodimeric Fc-based chimeric protein complexes, e.g. with the targeting domain on a different polypeptide than the signaling agent, combinatorial diversity of targeting moiety and signaling agent is provided in a practical manner. For instance, in embodiments, polypeptides with any of the targeting moieties described herein can be combined "off the shelf" with polypeptides with any of the signaling agents described herein to allow rapid generation of various combinations of targeting moieties and signaling agents in single Fc-based chimeric protein complexes.

In some embodiments, the Fc-based chimeric protein complex comprises one or more linkers. In some embodiments, the Fc-based chimeric protein complex includes a linker that connects the Fc domain, signaling agent(s) and targeting moiety(ies). In some embodiments, the Fc-based chimeric protein complex includes a linker that connects each signaling agent and targeting moiety (or, if more than one targeting moiety, a signaling agent to one of the targeting moieties). In some embodiments, the Fc-based chimeric protein complex includes a linker that connects each signaling agent to the Fc domain. In some embodiments, the Fc-based chimeric protein complex includes a linker that connects each targeting moiety to the Fc domain. In some embodiments, the Fc-based chimeric protein complex includes a linker that connects a targeting moiety to another targeting moiety. In some embodiments, the Fc-based chimeric protein complex includes a linker that connects a signaling agent to another signaling agent.

In some embodiments, an Fc-based chimeric protein complex comprises two or more targeting moieties. In such embodiments, the targeting moieties can be the same targeting moiety or they can be different targeting moieties.

In some embodiments, an Fc-based chimeric protein complex comprises two or more signaling agents. In such embodiments, the signaling agents can be the same targeting moiety or they can be different targeting moieties.

By way of example, in some embodiments, the Fc-based chimeric protein complex comprise an Fc domain, at least two signaling agents (SA), and at least two targeting moieties (TM), wherein the Fc domain, signaling agents, and targeting moieties are selected from any of the Fc domains, signaling agents, and targeting moieties disclosed herein. In some embodiments, the Fc domain is homodimeric.

In various embodiments, the Fc-based chimeric protein complex takes the form of any of the schematics of FIGS. 10A-F.

In various embodiments, the Fc-based chimeric protein complex takes the form of any of the schematics of FIGS. 11A-H.

In various embodiments, the Fc-based chimeric protein complex takes the form of any of the schematics of FIGS. 12A-H.

In various embodiments, the Fc-based chimeric protein complex takes the form of any of the schematics of FIGS. 13A-D.

In various embodiments, the Fc-based chimeric protein complex takes the form of any of the schematics of FIGS. 14A-F.

In various embodiments, the Fc-based chimeric protein complex takes the form of any of the schematics of FIGS. 15A-J.

In various embodiments, the Fc-based chimeric protein complex takes the form of any of the schematics of FIGS. 16A-D.

In various embodiments, the Fc-based chimeric protein complex takes the form of any of the schematics of FIGS. 17A-F.

In various embodiments, the Fc-based chimeric protein complex takes the form of any of the schematics of FIGS. 18A-J.

In various embodiments, the Fc-based chimeric protein complex takes the form of any of the schematics of FIGS. 19A-F.

In various embodiments, the Fc-based chimeric protein complex takes the form of any of the schematics of FIGS. 20A-L.

In various embodiments, the Fc-based chimeric protein complex takes the form of any of the schematics of FIGS. 21A-L.

In various embodiments, the Fc-based chimeric protein complex takes the form of any of the schematics of FIGS. 22A-F.

In various embodiments, the Fc-based chimeric protein complex takes the form of any of the schematics of FIGS. 23A-L.

In various embodiments, the Fc-based chimeric protein complex takes the form of any of the schematics of FIGS. 24A-L.

In various embodiments, the Fc-based chimeric protein complex takes the form of any of the schematics of FIGS. 25A-J.

In various embodiments, the Fc-based chimeric protein complex takes the form of any of the schematics of FIGS. 26A-J.

In various embodiments, the Fc-based chimeric protein complex takes the form of any of the schematics of FIGS. 27A-F.

In various embodiments, the Fc-based chimeric protein complex takes the form of any of the schematics of FIGS. 28A-F.

In various embodiments, the Fc-based chimeric protein complex takes the form of any of the schematics of FIGS. 29A-E.

In some embodiments, the signaling agents are linked to the targeting moieties and the targeting moieties are linked to the Fc domain on the same terminus (see FIGS. 10A-F). In some embodiments, the Fc domain is homodimeric.

In some embodiments, the signaling agents and targeting moieties are linked to the Fc domain, wherein the targeting moieties and signaling agents are linked on the same terminus (see FIGS. 10A-F). In some embodiments, the Fc domain is homodimeric.

In some embodiments, the targeting moieties are linked to signaling agents and the signaling agents are linked to the Fc domain on the same terminus (see FIGS. 10A-F). In some embodiments, the Fc domain is homodimeric.

In some embodiments, the homodimeric Fc-based chimeric protein complex has two or more targeting moieties. In some embodiments, there are four targeting moieties and two signaling agents, the targeting moieties are linked to the Fc domain and the signaling agents are linked to targeting moieties on the same terminus (see FIGS. 11A-H). In some embodiments, the Fc domain is homodimeric. In some embodiments, where there are four targeting moieties and two signaling agents, two targeting moieties are linked to the Fc domain and two targeting moieties are linked to the signaling agents, which are linked to the Fc domain on the same terminus (see FIGS. 11A-H). In some embodiments, the Fc domain is homodimeric. In some embodiments, where there are four targeting moieties and two signaling agents, two targeting moieties are linked to each other and one of the targeting moieties of from each pair is linked to the Fc domain on the same terminus and the signaling agents are linked to the Fc domain on the same terminus (see FIGS.

11A-H). In some embodiments, the Fc domain is homodimeric. In some embodiments, where there are four targeting moieties and two signaling agents, two targeting moieties are linked to each other, wherein one of the targeting moieties of from each pair is linked to a signaling agent and the other targeting moiety of the pair is linked the Fc domain, wherein the targeting moieties linked to the Fc domain are linked on the same terminus (see FIGS. 11A-H). In some embodiments, the Fc domain is homodimeric.

In some embodiments, the homodimeric Fc-based chimeric protein complex has two or more signaling agents. In some embodiments, where there are four signaling agents and two targeting moieties, two signaling agents are linked to each other and one of the signaling agents of from pair is linked to the Fc domain on the same terminus and the targeting moieties are linked to the Fc domain on the same terminus (see FIGS. 12A-H). In some embodiments, the Fc domain is homodimeric. In some embodiments, where there are four signaling agents and two targeting moieties, two signaling agents are linked to the Fc domain one the same terminus and two of the signaling agents are each linked to a targeting moiety, wherein the targeting moieties are linked to the Fc domain at the same terminus (see FIGS. 12A-H). In some embodiments, the Fc domain is homodimeric. In some embodiments, where there are four signaling agents and two targeting moieties, two signaling agents are linked to each other and one of the signaling agents of from pair is linked to a targeting moiety and the targeting moieties are linked to the Fc domain on the same terminus (see FIGS. 12A-H). In some embodiments, the Fc domain is homodimeric.

By way of example, in some embodiments, the Fc-based chimeric protein complex comprise an Fc domain, wherein the Fc domain comprises ionic pairing mutation(s) and/or knob-in-hole mutation(s), at least one signaling agent, and at least one targeting moiety, wherein the ionic pairing motif and/or a knob-in-hole motif, signaling agent, and targeting moiety are selected from any of the ionic pairing motif and/or a knob-in-hole motif, signaling agents, and targeting moieties disclosed herein. In some embodiments, the Fc domain is heterodimeric. In some embodiments, the Fc domain comprises a mutation that reduces or eliminates its effector function.

In some embodiments, the signaling agent is linked to the targeting moiety, which is linked to the Fc domain (see FIGS. 19A-F and 22A-F). In some embodiments, the targeting moiety is linked to the signaling agent, which is linked to the Fc domain (see FIGS. 19A-F and 22A-F). In some embodiments, the Fc domain is heterodimeric. In some embodiments, the Fc domain comprises a mutation that reduces or eliminates its effector function.

In some embodiments, the signaling agent and targeting moiety are linked to the Fc domain (see FIGS. 13A-D, 16A-D, 19A-F, and 22A-F). In some embodiments, the targeting moiety and the signaling agent are linked to different Fc chains on the same terminus (see FIGS. 13A-D and 16A-D). In some embodiments, the targeting moiety and the signaling agent are linked to different Fc chains on different termini (see FIGS. 13A-D and 16A-D).

In some embodiments, the targeting moiety and the signaling agent are linked to the same Fc chain (see FIGS. 19A-F and 22A-F). In some embodiments, the Fc domain is heterodimeric. In some embodiments, the Fc domain comprises a mutation that reduces or eliminates its effector function.

In some embodiments, where there are one signaling agent and two targeting moieties, the signaling agent is linked to the Fc domain and two targeting moieties can be: 1) linked to each other with one of the targeting moieties linked to the Fc domain; or 2) each linked to the Fc domain (see FIGS. 14A-F, 17A-F, 20A-L, 23A-L, 25A-J, and 26A-J). In some embodiments, the targeting moieties are linked on one Fc chain and the signaling agent is on the other Fc chain (see FIGS. 14A-F and 17A-F). In some embodiments, the paired targeting moieties and the signaling agent are linked to the same Fc chain (see FIGS. 20A-L and 23A-L). In some embodiments, a targeting moiety is linked to the Fc domain and the other targeting moiety is linked to the signaling agent, and the paired targeting moiety is linked to the Fc domain (see FIGS. 20A-L, 23A-L, 25A-J, and 26A-J). In some embodiments, the unpaired targeting moiety and paired targeting moiety are linked to the same Fc chain (see FIGS. 20A-L and 23A-L). In some embodiments, the unpaired targeting moiety and paired targeting moiety are linked to different Fc chains (see FIGS. 25A-J and 26A-J). In some embodiments, the unpaired targeting moiety and paired targeting moiety are linked on the same terminus (see FIGS. 25A-J and 26A-J). In some embodiments, the Fc domain is heterodimeric. In some embodiments, the Fc domain comprises a mutation that reduces or eliminates its effector function.

In some embodiments, where there are one signaling agent and two targeting moieties, a targeting moiety is linked to the signaling agent, which is linked to the Fc domain, and the unpaired targeting moiety is linked the Fc domain (see FIGS. 20A-L, 23A-L, 25A-J, and 26A-J). In some embodiments, the paired signaling agent and unpaired targeting moiety are linked to the same Fc chain (see FIGS. 20A-L and 23A-L). In some embodiments, the paired signaling agent and unpaired targeting moiety are linked to different Fc chains (see FIGS. 25A-J and 26A-J). In some embodiments, the paired signaling agent and unpaired targeting moiety are linked on the same terminus (see FIGS. 25A-J and 26A-J). In some embodiments, the Fc domain is heterodimeric. In some embodiments, the Fc domain comprises a mutation that reduces or eliminates its effector function.

In some embodiments, where there are one signaling agent and two targeting moieties, the targeting moieties are linked together and the signaling agent is linked to one of the paired targeting moieties, wherein the targeting moiety not linked to the signaling agent is linked to the Fc domain (see FIGS. 20A-L and 23A-L). In some embodiments, the Fc domain is heterodimeric. In some embodiments, the Fc domain comprises a mutation that reduces or eliminates its effector function.

In some embodiments, where there are one signaling agent and two targeting moieties, the targeting moieties are linked together and the signaling agent is linked to one of the paired targeting moieties, wherein the signaling agent is linked to the Fc domain (see FIGS. 20A-L and 23A-L). In some embodiments, the Fc domain is heterodimeric. In some embodiments, the Fc domain comprises a mutation that reduces or eliminates its effector function.

In some embodiments, where there are one signaling agent and two targeting moieties, the targeting moieties are both linked to the signaling agent, wherein one of the targeting moieties is linked to the Fc domain (see FIGS. 20A-L and 23A-L). In some embodiments, the Fc domain is heterodimeric. In some embodiments, the Fc domain comprises a mutation that reduces or eliminates its effector function.

In some embodiments, where there are one signaling agent and two targeting moieties, the targeting moieties and the signaling agent are linked to the Fc domain (see FIGS. 25A-J and 26A-J). In some embodiments, the targeting moieties are linked on the terminus (see FIGS. 25A-J and 26A-J). In some embodiments, the Fc domain is heterodimeric. In some embodiments, the Fc domain comprises a mutation that reduces or eliminates its effector function.

In some embodiments, where there are two signaling agents and one targeting moiety, the signaling agents are linked to the Fc domain on the same terminus and the targeting moiety is linked to the Fc domain (see FIGS. 15A-J and 18A-J). In some embodiments, the signaling agents are linked to the Fc domain on the same Fc chain and the targeting moiety is linked on the other Fc chain (see FIGS. 27A-F and 28A-F). In some embodiments, the Fc domain is heterodimeric. In some embodiments, the Fc domain comprises a mutation that reduces or eliminates its effector function.

In some embodiments, where there are two signaling agents and one targeting moiety, a signaling agent is linked to the targeting moiety, which is linked to the Fc domain and the other signaling agent is linked to the Fc domain (see FIGS. 15A-J, 18A-J, 21A-L, and 24A-L). In some embodiments, the targeting moiety and the unpaired signaling agent are linked to different Fc chains (see FIGS. 15A-J and 18A-J). In some embodiments, the targeting moiety and the unpaired signaling agent are linked to different Fc chains on the same terminus (see FIGS. 15A-J and 18A-J). In some embodiments, the targeting moiety and the unpaired signaling agent are linked to different Fc chains on different termini (see FIGS. 15A-J and 18A-J). In some embodiments, the targeting moiety and the unpaired signaling agent are linked to the same Fc chains (see FIGS. 21A-L and 24A-L). In some embodiments, the Fc domain is heterodimeric. In some embodiments, the Fc domain comprises a mutation that reduces or eliminates its effector function.

In some embodiments, where there are two signaling agents and one targeting moiety, the targeting moiety is linked to a signaling agent, which is linked to the Fc domain and the other signaling agent is linked to the Fc domain (see FIGS. 15A-J and 18A-J). In some embodiments, the paired signaling agent and the unpaired signaling agent are linked to different Fc chains (see FIGS. 15A-J and 18A-J). In some embodiments, the paired signaling agent and the unpaired signaling agent are linked to different Fc chains on the same terminus (see FIGS. 15A-J and 18A-J). In some embodiments, the paired signaling agent and the unpaired signaling agent are linked to different Fc chains on different termini (see FIGS. 15A-J and 18A-J). In some embodiments, the Fc domain is heterodimeric. In some embodiments, the Fc domain comprises a mutation that reduces or eliminates its effector function.

In some embodiments, where there are two signaling agents and one targeting moiety, the signaling agents are linked together and the targeting moiety is linked to one of the paired signaling agents, wherein the targeting moiety is linked to the Fc domain (see FIGS. 21A-L and 24A-L). In some embodiments, the Fc domain is heterodimeric. In some embodiments, the Fc domain comprises a mutation that reduces or eliminates its effector function.

In some embodiments, where there are two signaling agents and one targeting moiety, the signaling agents are linked together and one of the signaling agents is linked to the Fc domain and the targeting moiety is linked to the Fc domain (see FIGS. 21A-L, 24A-L, 27A-F, and 28A-F). In some embodiments, the paired signaling agents and targeting moiety are linked to the same Fc chain (see FIGS. 21A-L and 124A-L). In some embodiments, the paired signaling agents and targeting moiety are linked to different Fc chains (see FIGS. 27A-F and 28A-F). In some embodiments, the paired signaling agents and targeting moiety are linked to different Fc chains on the same terminus (see FIGS. 27A-F and 28A-F). In some embodiments, the Fc domain is heterodimeric. In some embodiments, the Fc domain comprises a mutation that reduces or eliminates its effector function.

In some embodiments, where there are two signaling agents and one targeting moiety, the signaling agents are both linked to the targeting moiety, wherein one of the signaling agents is linked to the Fc domain (see FIGS. 21A-L and 24A-L). In some embodiments, the Fc domain is heterodimeric. In some embodiments, the Fc domain comprises a mutation that reduces or eliminates its effector function.

In some embodiments, where there are two signaling agents and one targeting moiety, the signaling agents are linked together and one of the signaling agents is linked to the targeting moiety and the other signaling agent is linked to the Fc domain (see FIGS. 21A-L and 24A-L).

In some embodiments, where there are two signaling agents and one targeting moiety, each signaling agent is linked to the Fc domain and the targeting moiety is linked to one of the signaling agents (see FIGS. 21A-L and 24A-L). In some embodiments, the signaling agents are linked to the same Fc chain (see FIGS. 21A-L and 24A-L).

In some embodiments, a targeting moiety or signaling agent is linked to the Fc domain, comprising one or both of $C_H2$ and $C_H3$ domains, and optionally a hinge region. For example, vectors encoding the targeting moiety, signaling agent, or combination thereof, linked as a single nucleotide sequence to an Fc domain can be used to prepare such polypeptides.

In some embodiments, the linker may be utilized to link various functional groups, residues, or moieties as described herein to the Fc-based chimeric protein complex. In some embodiments, the linker is a single amino acid or a plurality of amino acids that does not affect or reduce the stability, orientation, binding, neutralization, and/or clearance characteristics of the binding regions and the binding protein. In various embodiments, the linker is selected from a peptide, a protein, a sugar, or a nucleic acid.

In some embodiments, the Fc-based chimeric protein complex comprises a linker connecting a targeting moiety and the signaling agent. In some embodiments, the Fc-based chimeric protein complex comprises a linker within the signaling agent (e.g. in the case of single chain TNF, which can comprise two linkers to yield a trimer or in the case of IFN gamma, which can comprise a linkers to yield a dimer).

The present technology contemplates the use of a variety of linker sequences. In various embodiments, the linker may be derived from naturally-occurring multi-domain proteins or are empirical linkers as described, for example, in Chichili et al., (2013), Protein Sci. 22(2):153-167, Chen et al., (2013), Adv Drug Deliv Rev. 65(10):1357-1369, the entire contents of which are hereby incorporated by reference. In some embodiments, the linker may be designed using linker designing databases and computer programs such as those described in Chen et al., (2013), Adv Drug Deliv Rev. 65(10):1357-1369 and Crasto et al., (2000), Protein Eng. 13(5):309-312, the entire contents of which are hereby incorporated by reference. In various embodiments, the linker may be functional. For example, without limitation, the linker may function to improve the folding and/or stability, improve the expression, improve the pharmacokinetics, and/or improve the bioactivity of the Fc-based chimeric protein complex In some embodiments, the linker is a polypeptide. In some embodiments, the linker is less than about 100 amino acids long. For example, the linker may be less than about 100, about 95, about 90, about 85, about 80, about 75, about 70, about 65, about 60, about 55, about 50, about 45, about 40, about 35, about 30, about 25, about 20, about 19, about 18, about 17, about 16, about 15, about 14, about 13, about 12, about 11, about 10, about 9, about 8, about 7, about 6, about 5, about 4, about 3, or about 2 amino acids long. In some embodiments, the linker is a polypeptide. In some embodiments, the linker is greater than about 100 amino acids long. For example, the linker may be greater than about 100, about 95, about 90, about 85, about 80, about 75, about 70, about 65, about 60, about 55, about 50, about 45, about 40, about 35, about 30, about 25, about 20, about 19, about 18, about 17, about 16, about 15, about 14, about 13, about 12, about 11, about 10, about 9, about 8, about 7, about 6, about 5, about 4, about 3, or about 2 amino acids long. In some embodiments, the linker is flexible. In another embodiment, the linker is rigid.

In some embodiments, the linker length allows for efficient binding of a targeting moiety, a signaling agent, and/or an Fc domain to their targets (e.g., receptors). For instance, in some embodiments, the linker length allows for efficient binding of one of the targeting moieties and the signaling agent to receptors on the same cell as well as the efficient binding of the other targeting moiety to another cell. Illustrative pairs of cells are provided elsewhere herein.

In some embodiments the linker length is at least equal to the minimum distance between the binding sites of a targeting moiety, a signaling agent, and/or an Fc domain targets (e.g., receptors) on the same cell. In some embodiments the linker length is at least twice, or three times, or four times, or five times, or ten times, or twenty times, or 25 times, or 50 times, or one hundred times, or more the minimum distance between the binding sites of a targeting moiety, a signaling agent, and/or an Fc domain targets on the same cell.

In some embodiments, a linker connects the two targeting moieties to each other and this linker has a short length and a linker connects a targeting moiety and a signaling agent this linker is longer than the linker connecting the two targeting moieties. For example, the difference in amino acid length between the linker connecting the two targeting moieties and the linker connecting a targeting moiety and a signaling agent may be about 100, about 95, about 90, about 85, about 80, about 75, about 70, about 65, about 60, about 55, about 50, about 45, about 40, about 35, about 30, about 25, about 20, about 19, about 18, about 17, about 16, about 15, about 14, about 13, about 12, about 11, about 10, about 9, about 8, about 7, about 6, about 5, about 4, about 3, or about 2 amino acids. In some embodiments, the linker is flexible. In another embodiment, the linker is rigid.

In various embodiments, the linker is substantially comprised of glycine and serine residues (e.g. about 30%, or about 40%, or about 50%, or about 60%, or about 70%, or about 80%, or about 90%, or about 95%, or about 97% glycines and serines). For example, in some embodiments, the linker is $(Gly_4Ser)_n$, where n is from about 1 to about 8, e.g. 1, 2, 3, 4, 5, 6, 7, or 8 (SEQ ID NO: 247-SEQ ID NO: 254). In an embodiment, the linker sequence is GGSGGSGGGGSGGGS (SEQ ID NO: 255). Additional illustrative linkers include, but are not limited to, linkers having the sequence LE, GGGGS (SEQ ID NO: 247), $(GGGGS)_n$ (n=1-4) (SEQ ID NO: 247-SEQ ID NO: 250), $(Gly)_8$ (SEQ ID NO: 256), $(Gly)_6$ (SEQ ID NO: 257), $(EAAAK)_n$ (n=1-3) (SEQ ID NO: 258-SEQ ID NO: 260), $A(EAAAK)_nA$ (n=2-5) (SEQ ID NO: 261-SEQ ID NO: 264), AEAAAKEAAAKA (SEQ ID NO: 261), $A(EAAAK)_4$ ALEA(EAAAK)$_4$A (SEQ ID NO: 265), PAPAP (SEQ ID NO: 266), KESGSVSSEQLAQFRSLD (SEQ ID NO: 267), EGKSSGSGSESKST (SEQ ID NO: 268), GSAGSAAGSGEF (SEQ ID NO: 269), and $(XP)_n$, with X designating any amino acid, e.g., Ala, Lys, or Glu. In various embodiments, the linker is $(GGS)_n$ (n=1-20) (SEQ ID NOs: 1162-1181). In some embodiments, the linker is G. In some embodiments, the linker is AAA. In some embodiments, the linker is $(GGGGS)_n$ (n=5-20) (SEQ ID NOs: 251-254 and SEQ ID NOs: 1182-1193).

In some embodiments, the linker is one or more of GGGSE (SEQ ID NO: 270), GSESG (SEQ ID NO: 271), GSEGS (SEQ ID NO: 272), GEGGSGEGSSGEGSSEGGGSEGGGSEGGGSEGGS (SEQ ID NO: 273), and a linker of randomly placed G, S, and E every 4 amino acid intervals.

In some embodiments, the linker is a hinge region of an antibody (e.g., of IgG, IgA, IgD, and IgE, inclusive of subclasses (e.g. IgG1, IgG2, IgG3, and IgG4, and IgA1 and IgA2)). In various embodiments, the linker is a hinge region of an antibody (e.g., of IgG, IgA, IgD, and IgE, inclusive of subclasses (e.g. IgG1, IgG2, IgG3, and IgG4, and IgA1 and IgA2)). The hinge region, found in IgG, IgA, IgD, and IgE class antibodies, acts as a flexible spacer, allowing the Fab portion to move freely in space. In contrast to the constant regions, the hinge domains are structurally diverse, varying in both sequence and length among immunoglobulin classes and subclasses. For example, the length and flexibility of the hinge region varies among the IgG subclasses. The hinge region of IgG1 encompasses amino acids 216-231 and, because it is freely flexible, the Fab fragments can rotate about their axes of symmetry and move within a sphere centered at the first of two inter-heavy chain disulfide bridges. IgG2 has a shorter hinge than IgG1, with 12 amino acid residues and four disulfide bridges. The hinge region of IgG2 lacks a glycine residue, is relatively short, and contains a rigid poly-proline double helix, stabilized by extra inter-heavy chain disulfide bridges. These properties restrict the flexibility of the IgG2 molecule. IgG3 differs from the other subclasses by its unique extended hinge region (about four times as long as the IgG1 hinge), containing 62 amino acids (including 21 prolines and 11 cysteines), forming an inflexible poly-proline double helix. In IgG3, the Fab fragments are relatively far away from the Fc fragment, giving the molecule a greater flexibility. The elongated hinge in IgG3 is also responsible for its higher molecular weight compared to the other subclasses. The hinge region of IgG4 is shorter than that of IgG1 and its flexibility is intermediate between that of IgG1 and IgG2. The flexibility of the hinge regions reportedly decreases in the order IgG3>IgG1>IgG4>IgG2.

According to crystallographic studies, the immunoglobulin hinge region can be further subdivided functionally into three regions: the upper hinge region, the core region, and the lower hinge region. See Shin et al., 1992 *Immunological Reviews* 130:87. The upper hinge region includes amino acids from the carboxyl end of $C_H1$ to the first residue in the hinge that restricts motion, generally the first cysteine residue that forms an interchain disulfide bond between the two heavy chains. The length of the upper hinge region correlates with the segmental flexibility of the antibody. The core hinge region contains the inter-heavy chain disulfide bridges, and the lower hinge region joins the amino terminal end of the $C_{H2}$ domain and includes residues in $C_{H2}$. Id. The core hinge region of wild-type human IgG1 contains the sequence Cys-Pro-Pro-Cys (SEQ ID NO: 274) which, when dimerized by disulfide bond formation, results in a cyclic octapeptide believed to act as a pivot, thus conferring flexibility. In various embodiments, the present linker comprises, one, or two, or three of the upper hinge region, the core region, and the lower hinge region of any antibody (e.g., of IgG, IgA, IgD, and IgE, inclusive of subclasses (e.g. IgG1, IgG2, IgG3, and IgG4, and IgA1 and IgA2)). The hinge region may also contain one or more glycosylation sites, which include a number of structurally distinct types of sites for carbohydrate attachment. For example, IgA1 contains five glycosylation sites within a 17-amino-acid segment of the hinge region, conferring resistance of the hinge region polypeptide to intestinal proteases, considered an advantageous property for a secretory immunoglobulin. In various embodiments, the linker of the present invention comprises one or more glycosylation sites. In various embodiments, the linker is a hinge-CH2-CH3 domain of a human IgG4 antibody.

If desired, the present chimeric protein can be linked to an antibody Fc region, comprising one or both of $C_H2$ and $C_H3$ domains, and optionally a hinge region. For example, vectors encoding the present chimeric proteins or chimeric protein complexes linked as a single nucleotide sequence to an Fc region can be used to prepare such polypeptides.

In some embodiments, the linker is a synthetic linker such as PEG.

In various embodiments, the linker may be functional. For example, without limitation, the linker may function to improve the folding and/or stability, improve the expression, improve the pharmacokinetics, and/or improve the bioactivity of the present chimeric protein. In another example, the linker may function to target the chimeric protein or chimeric protein complex to a particular cell type or location.

Pharmaceutically Acceptable Salts and Excipients

The chimeric proteins or chimeric protein complexes described herein can possess a sufficiently basic functional group, which can react with an inorganic or organic acid, or a carboxyl group, which can react with an inorganic or organic base, to form a pharmaceutically acceptable salt. A pharmaceutically acceptable acid addition salt is formed from a pharmaceutically acceptable acid, as is well known in the art. Such salts include the pharmaceutically acceptable salts listed in, for example, *Journal of Pharmaceutical Science,* 66, 2-19 (1977) and *The Handbook of Pharmaceutical Salts; Properties, Selection, and Use*. P. H. Stahl and C. G. Wermuth (eds.), Verlag, Zurich (Switzerland) 2002, which are hereby incorporated by reference in their entirety.

Pharmaceutically acceptable salts include, by way of non-limiting example, sulfate, citrate, acetate, oxalate, chloride, bromide, iodide, nitrate, bisulfate, phosphate, acid phosphate, isonicotinate, lactate, salicylate, acid citrate, tartrate, oleate, tannate, pantothenate, bitartrate, ascorbate, succinate, maleate, gentisinate, fumarate, gluconate, glucaronate, saccharate, formate, benzoate, glutamate, methanesulfonate, ethanesulfonate, benzenesulfonate, p-toluenesulfonate, camphorsulfonate, pamoate, phenylacetate, trifluoroacetate, acrylate, chlorobenzoate, dinitrobenzoate, hydroxybenzoate, methoxybenzoate, methylbenzoate, o-acetoxybenzoate, naphthalene-2-benzoate, isobutyrate, phenylbutyrate, α-hydroxybutyrate, butyne-1,4-dicarboxylate, hexyne-1,4-dicarboxylate, caprate, caprylate, cinnamate, glycollate, heptanoate, hippurate, malate, hydroxymaleate, malonate, mandelate, mesylate, nicotinate, phthalate, teraphthalate, propiolate, propionate, phenylpropionate, sebacate, suberate, p-bromobenzenesulfonate, chlorobenzenesulfonate, ethylsulfonate, 2-hydroxyethylsulfonate, methylsulfonate, naphthalene-1-sulfonate, naphthalene-2-sulfonate, naphthalene-1,5-sulfonate, xylenesulfonate, and tartarate salts.

The term "pharmaceutically acceptable salt" also refers to a salt of the compositions of the present invention having an acidic functional group, such as a carboxylic acid functional group, and a base. Suitable bases include, but are not limited to, hydroxides of alkali metals such as sodium, potassium, and lithium; hydroxides of alkaline earth metal such as calcium and magnesium; hydroxides of other metals, such as aluminum and zinc; ammonia, and organic amines, such as unsubstituted or hydroxy-substituted mono-, di-, or trialkylamines, dicyclohexylamine; tributyl amine; pyridine; N-methyl, N-ethylamine; diethylamine; triethylamine; mono-, bis-, or tris-(2-OH-lower alkylamines), such as mono-; bis-, or tris-(2-hydroxyethyl)amine, 2-hydroxy-tert-butylamine, or tris-(hydroxymethyl)methylamine, N,N-di-lower alkyl-N-(hydroxyl-lower alkyl)-amines, such as N,N-dimethyl-N-(2-hydroxyethyl)amine or tri-(2-hydroxyethyl)amine; N-methyl-D-glucamine; and amino acids such as arginine, lysine, and the like.

In some embodiments, the compositions described herein are in the form of a pharmaceutically acceptable salt.

Pharmaceutical Compositions and Formulations

In various embodiments, the present invention pertains to pharmaceutical compositions comprising the chimeric proteins or chimeric protein complexes described herein and a pharmaceutically acceptable carrier or excipient. Any pharmaceutical compositions described herein can be administered to a subject as a component of a composition that comprises a pharmaceutically acceptable carrier or vehicle. Such compositions can optionally comprise a suitable amount of a pharmaceutically acceptable excipient so as to provide the form for proper administration.

In various embodiments, pharmaceutical excipients can be liquids, such as water and oils, including those of petroleum, animal, vegetable, or synthetic origin, such as peanut oil, soybean oil, mineral oil, sesame oil and the like. The pharmaceutical excipients can be, for example, saline, gum acacia, gelatin, starch paste, talc, keratin, colloidal silica, urea and the like. In addition, auxiliary, stabilizing, thickening, lubricating, and coloring agents can be used. In one embodiment, the pharmaceutically acceptable excipients are sterile when administered to a subject. Water is a useful excipient when any agent described herein is administered intravenously. Saline solutions and aqueous dextrose and glycerol solutions can also be employed as liquid excipients, specifically for injectable solutions. Suitable pharmaceutical excipients also include starch, glucose, lactose, sucrose, gelatin, malt, rice, flour, chalk, silica gel, sodium stearate, glycerol monostearate, talc, sodium chloride, dried skim milk, glycerol, propylene, glycol, water, ethanol and the like. Any agent described herein, if desired, can also comprise minor amounts of wetting or emulsifying agents, or pH buffering agents. Other examples of suitable pharmaceutical excipients are described in *Remington's Pharmaceutical Sciences* 1447-1676 (Alfonso R. Gennaro eds., 19th ed. 1995), incorporated herein by reference.

The present invention includes the described pharmaceutical compositions (and/or additional therapeutic agents) in various formulations. Any inventive pharmaceutical composition (and/or additional therapeutic agents) described herein can take the form of solutions, suspensions, emulsion, drops, tablets, pills, pellets, capsules, capsules containing liquids, gelatin capsules, powders, sustained-release formulations, suppositories, emulsions, aerosols, sprays, suspensions, lyophilized powder, frozen suspension, desiccated powder, or any other form suitable for use. In one embodiment, the composition is in the form of a capsule. In another embodiment, the composition is in the form of a tablet. In yet another embodiment, the pharmaceutical composition is formulated in the form of a soft-gel capsule. In a further embodiment, the pharmaceutical composition is formulated in the form of a gelatin capsule. In yet another embodiment, the pharmaceutical composition is formulated as a liquid.

Where necessary, the inventive pharmaceutical compositions (and/or additional agents) can also include a solubilizing agent. Also, the agents can be delivered with a suitable vehicle or delivery device as known in the art. Combination therapies outlined herein can be co-delivered in a single delivery vehicle or delivery device.

The formulations comprising the inventive pharmaceutical compositions (and/or additional agents) of the present invention may conveniently be presented in unit dosage forms and may be prepared by any of the methods well known in the art of pharmacy. Such methods generally include the step of bringing the therapeutic agents into association with a carrier, which constitutes one or more accessory ingredients. Typically, the formulations are prepared by uniformly and intimately bringing the therapeutic agent into association with a liquid carrier, a finely divided solid carrier, or both, and then, if necessary, shaping the product into dosage forms of the desired formulation (e.g., wet or dry granulation, powder blends, etc., followed by tableting using conventional methods known in the art).

In various embodiments, any pharmaceutical compositions (and/or additional agents) described herein is formulated in accordance with routine procedures as a composition adapted for a mode of administration described herein.

Routes of administration include, for example: oral, intradermal, intramuscular, intraperitoneal, intravenous, subcutaneous, intranasal, epidural, sublingual, intranasal, intracerebral, intravaginal, transdermal, rectally, by inhalation, or topically. Administration can be local or systemic. In some embodiments, the administering is effected orally. In another embodiment, the administration is by parenteral injection. The mode of administration can be left to the discretion of the practitioner, and depends in-part upon the site of the medical condition. In most instances, administration results in the release of any agent described herein into the bloodstream.

In one embodiment, the chimeric protein or chimeric protein complex described herein is formulated in accordance with routine procedures as a composition adapted for oral administration. Compositions for oral delivery can be in the form of tablets, lozenges, aqueous or oily suspensions, granules, powders, emulsions, capsules, syrups, or elixirs, for example. Orally administered compositions can comprise one or more agents, for example, sweetening agents such as fructose, aspartame or saccharin; flavoring agents such as peppermint, oil of wintergreen, or cherry; coloring agents; and preserving agents, to provide a pharmaceutically palatable preparation. Moreover, where in tablet or pill form, the compositions can be coated to delay disintegration and absorption in the gastrointestinal tract thereby providing a sustained action over an extended period of time. Selectively permeable membranes surrounding an osmotically active driving any chimeric proteins or chimeric protein complexes described herein are also suitable for orally administered compositions. In these latter platforms, fluid from the environment surrounding the capsule is imbibed by the driving compound, which swells to displace the agent or agent composition through an aperture. These delivery platforms can provide an essentially zero order delivery profile as opposed to the spiked profiles of immediate release formulations. A time-delay material such as glycerol monostearate or glycerol stearate can also be useful. Oral compositions can include standard excipients such as mannitol, lactose, starch, magnesium stearate, sodium saccharin, cellulose, and magnesium carbonate. In one embodiment, the excipients are of pharmaceutical grade. Suspensions, in addition to the active compounds, may contain suspending agents such as, for example, ethoxylated isostearyl alcohols, polyoxyethylene sorbitol and sorbitan esters, microcrystalline cellulose, aluminum metahydroxide, bentonite, agar-agar, tragacanth, etc., and mixtures thereof.

Dosage forms suitable for parenteral administration (e.g. intravenous, intramuscular, intraperitoneal, subcutaneous and intra-articular injection and infusion) include, for example, solutions, suspensions, dispersions, emulsions, and the like. They may also be manufactured in the form of sterile solid compositions (e.g. lyophilized composition), which can be dissolved or suspended in sterile injectable medium immediately before use. They may contain, for example, suspending or dispersing agents known in the art. Formulation components suitable for parenteral administration include a sterile diluent such as water for injection, saline solution, fixed oils, polyethylene glycols, glycerine, propylene glycol or other synthetic solvents; antibacterial agents such as benzyl alcohol or methyl paraben; antioxidants such as ascorbic acid or sodium bisulfite; chelating agents such as EDTA; buffers such as acetates, citrates or phosphates; and agents for the adjustment of tonicity such as sodium chloride or dextrose.

For intravenous administration, suitable carriers include physiological saline, bacteriostatic water, Cremophor ELTM (BASF, Parsippany, NJ) or phosphate buffered saline (PBS). The carrier should be stable under the conditions of manufacture and storage, and should be preserved against microorganisms. The carrier can be a solvent or dispersion medium containing, for example, water, ethanol, polyol (for example, glycerol, propylene glycol, and liquid polyetheylene glycol), and suitable mixtures thereof.

The compositions provided herein, alone or in combination with other suitable components, can be made into aerosol formulations (i.e., "nebulized") to be administered via inhalation. Aerosol formulations can be placed into pressurized acceptable propellants, such as dichlorodifluoromethane, propane, nitrogen, and the like.

Any inventive pharmaceutical compositions (and/or additional agents) described herein can be administered by controlled-release or sustained-release means or by delivery devices that are well known to those of ordinary skill in the art. Examples include, but are not limited to, those described in U.S. Pat. Nos. 3,845,770; 3,916,899; 3,536,809; 3,598,123; 4,008,719; 5,674,533; 5,059,595; 5,591,767; 5,120,548; 5,073,543; 5,639,476; 5,354,556; and 5,733,556, each of which is incorporated herein by reference in its entirety. Such dosage forms can be useful for providing controlled- or sustained-release of one or more active ingredients using, for example, hydropropyl cellulose, hydropropylmethyl cellulose, polyvinylpyrrolidone, other polymer matrices, gels, permeable membranes, osmotic systems, multilayer coatings, microparticles, liposomes, microspheres, or a combination thereof to provide the desired release profile in varying proportions. Suitable controlled- or sustained-release formulations known to those skilled in the art, including those described herein, can be readily selected for use with the active ingredients of the agents described herein. The invention thus provides single unit dosage forms suitable for oral administration such as, but not limited to, tablets, capsules, gelcaps, and caplets that are adapted for controlled- or sustained-release.

Controlled- or sustained-release of an active ingredient can be stimulated by various conditions, including but not limited to, changes in pH, changes in temperature, stimulation by an appropriate wavelength of light, concentration or availability of enzymes, concentration or availability of water, or other physiological conditions or compounds.

In another embodiment, a controlled-release system can be placed in proximity of the target area to be treated, thus requiring only a fraction of the systemic dose (see, e.g., Goodson, in *Medical Applications of Controlled Release*, supra, vol. 2, pp. 115-138 (1984)). Other controlled-release systems discussed in the review by Langer, 1990, Science 249:1527-1533) may be used.

Pharmaceutical formulations preferably are sterile. Sterilization can be accomplished, for example, by filtration through sterile filtration membranes. Where the composition is lyophilized, filter sterilization can be conducted prior to or following lyophilization and reconstitution.

Administration and Dosage

It will be appreciated that the actual dose of the chimeric protein or chimeric protein complex to be administered according to the present invention will vary according to the particular dosage form, and the mode of administration. Many factors that may modify the action of the chimeric protein or chimeric protein complex (e.g., body weight, gender, diet, time of administration, route of administration, rate of excretion, condition of the subject, drug combinations, genetic disposition and reaction sensitivities) can be taken into account by those skilled in the art. Administration can be carried out continuously or in one or more discrete doses within the maximum tolerated dose. Optimal administration rates for a given set of conditions can be ascertained by those skilled in the art using conventional dosage administration tests.

In some embodiments, a suitable dosage of the chimeric protein or chimeric protein complex is in a range of about 0.01 mg/kg to about 10 g/kg of body weight of the subject, about 0.01 mg/kg to about 1 g/kg of body weight of the subject, about 0.01 mg/kg to about 100 mg/kg of body weight of the subject, about 0.01 mg/kg to about 10 mg/kg of body weight of the subject, for example, about 0.01 mg/kg, about 0.02 mg/kg, about 0.03 mg/kg, about 0.04 mg/kg, about 0.05 mg/kg, about 0.06 mg/kg, about 0.07 mg/kg, about 0.08 mg/kg, about 0.09 mg/kg, about 0.1 mg/kg, about 0.2 mg/kg, about 0.3 mg/kg, about 0.4 mg/kg, about 0.5 mg/kg, about 0.6 mg/kg, about 0.7 mg/kg, about 0.8 mg/kg, about 0.9 mg/kg, about 1 mg/kg, about 1.1 mg/kg, about 1.2 mg/kg, about 1.3 mg/kg, about 1.4 mg/kg, about 1.5 mg/kg, about 1.6 mg/kg, about 1.7 mg/kg, about 1.8 mg/kg, 1.9 mg/kg, about 2 mg/kg, about 3 mg/kg, about 4 mg/kg, about 5 mg/kg, about 6 mg/kg, about 7 mg/kg, about 8 mg/kg, about 9 mg/kg, about 10 mg/kg body weight, about 100 mg/kg body weight, about 1 g/kg of body weight, about 10 g/kg of body weight, inclusive of all values and ranges therebetween.

Individual doses of the chimeric protein or chimeric protein complex can be administered in unit dosage forms (e.g., tablets or capsules) containing, for example, from about 0.01 mg to about 100 g, from about 0.01 mg to about 75 g, from about 0.01 mg to about 50 g, from about 0.01 mg to about 25 g, about 0.01 mg to about 10 g, about 0.01 mg to about 7.5 g, about 0.01 mg to about 5 g, about 0.01 mg to about 2.5 g, about 0.01 mg to about 1 g, about 0.01 mg to about 100 mg, from about 0.1 mg to about 100 mg, from about 0.1 mg to about 90 mg, from about 0.1 mg to about 80 mg, from about 0.1 mg to about 70 mg, from about 0.1 mg to about 60 mg, from about 0.1 mg to about 50 mg, from about 0.1 mg to about 40 mg active ingredient, from about 0.1 mg to about 30 mg, from about 0.1 mg to about 20 mg, from about 0.1 mg to about 10 mg, from about 0.1 mg to about 5 mg, from about 0.1 mg to about 3 mg, from about 0.1 mg to about 1 mg per unit dosage form, or from about 5 mg to about 80 mg per unit dosage form. For example, a unit dosage form can be about 0.01 mg, about 0.02 mg, about 0.03 mg, about 0.04 mg, about 0.05 mg, about 0.06 mg, about 0.07 mg, about 0.08 mg, about 0.09 mg, about 0.1 mg, about 0.2 mg, about 0.3 mg, about 0.4 mg, about 0.5 mg, about 0.6 mg, about 0.7 mg, about 0.8 mg, about 0.9 mg, about 1 mg, about 2 mg, about 3 mg, about 4 mg, about 5 mg, about 6 mg, about 7 mg, about 8 mg, about 9 mg about 10 mg, about 15 mg, about 20 mg, about 25 mg, about 30 mg, about 35 mg, about 40 mg, about 45 mg, about 50 mg, about 55 mg, about 60 mg, about 65 mg, about 70 mg, about 75 mg, about 80 mg, about 85 mg, about 90 mg, about 95 mg, about 100 mg, about 200 mg, about 500 mg, about 1 g, about 2.5 g, about 5 g, about 10 g, about 25 g, about 50 g, about 75 g, about 100 g, inclusive of all values and ranges therebetween.

In one embodiment, the chimeric protein or chimeric protein complex is administered at an amount of from about 0.01 mg to about 100 g daily, from about 0.01 mg to about 75 g daily, from about 0.01 mg to about 50 g daily, from about 0.01 mg to about 25 g daily, from about 0.01 mg to about 10 g daily, from about 0.01 mg to about 7.5 g daily, from about 0.01 mg to about 5 g daily, from about 0.01 mg to about 2.5 g daily, from about 0.01 mg to about 1 g daily, from about 0.01 mg to about 100 mg daily, from about 0.1 mg to about 100 mg daily, from about 0.1 mg to about 95 mg daily, from about 0.1 mg to about 90 mg daily, from about 0.1 mg to about 85 mg daily, from about 0.1 mg to about 80 mg daily, from about 0.1 mg to about 75 mg daily, from about 0.1 mg to about 70 mg daily, from about 0.1 mg to about 65 mg daily, from about 0.1 mg to about 60 mg daily, from about 0.1 mg to about 55 mg daily, from about 0.1 mg to about 50 mg daily, from about 0.1 mg to about 45 mg daily, from about 0.1 mg to about 40 mg daily, from about 0.1 mg to about 35 mg daily, from about 0.1 mg to about 30 mg daily, from about 0.1 mg to about 25 mg daily, from about 0.1 mg to about 20 mg daily, from about 0.1 mg to about 15 mg daily, from about 0.1 mg to about 10 mg daily, from about 0.1 mg to about 5 mg daily, from about 0.1 mg to about 3 mg daily, from about 0.1 mg to about 1 mg daily, or from about 5 mg to about 80 mg daily. In various embodiments, the chimeric protein or chimeric protein complex is administered at a daily dose of about 0.01 mg, about 0.02 mg, about 0.03 mg, about 0.04 mg, about 0.05 mg, about 0.06 mg, about 0.07 mg, about 0.08 mg, about 0.09 mg, about 0.1 mg, about 0.2 mg, about 0.3 mg, about 0.4 mg, about 0.5 mg, about 0.6 mg, about 0.7 mg, about 0.8 mg, about 0.9 mg, about 1 mg, about 2 mg, about 3 mg, about 4 mg, about 5 mg, about 6 mg, about 7 mg, about 8 mg, about 9 mg about 10 mg, about 15 mg, about 20 mg, about 25 mg, about 30 mg, about 35 mg, about 40 mg, about 45 mg, about 50 mg, about 55 mg, about 60 mg, about 65 mg, about 70 mg, about 75 mg, about 80 mg, about 85 mg, about 90 mg, about 95 mg, about 100 mg, about 200 mg, about 500 mg, about 1 g, about 2.5 g, about 5 g, about 7.5 g, about 10 g, about 25 g, about 50 g, about 75 g, about 100 g, inclusive of all values and ranges therebetween.

In accordance with certain embodiments of the invention, the pharmaceutical composition comprising the chimeric protein or chimeric protein complex may be administered, for example, more than once daily (e.g., about two times, about three times, about four times, about five times, about six times, about seven times, about eight times, about nine times, or about ten times daily), about once per day, about every other day, about every third day, about once a week, about once every two weeks, about once every month, about once every two months, about once every three months, about once every six months, or about once every year.

Combination Therapy and Additional Therapeutic Agents

In various embodiments, the pharmaceutical composition of the present invention is co-administered in conjunction with additional therapeutic agent(s). Co-administration can be simultaneous or sequential.

In one embodiment, the additional therapeutic agent and the chimeric protein or chimeric protein complex of the present invention are administered to a subject simultaneously. The term "simultaneously" as used herein, means that the additional therapeutic agent and the chimeric protein or chimeric protein complex are administered with a time separation of no more than about 60 minutes, such as no more than about 30 minutes, no more than about 20 minutes, no more than about 10 minutes, no more than about 5 minutes, or no more than about 1 minute. Administration of the additional therapeutic agent and the chimeric protein or chimeric protein complex can be by simultaneous administration of a single formulation (e.g., a formulation comprising the additional therapeutic agent and the chimeric protein) or of separate formulations (e.g., a first formulation including the additional therapeutic agent and a second formulation including the chimeric protein).

Co-administration does not require the therapeutic agents to be administered simultaneously, if the timing of their administration is such that the pharmacological activities of the additional therapeutic agent and the chimeric protein or chimeric protein complex overlap in time, thereby exerting a combined therapeutic effect. For example, the additional therapeutic agent and the chimeric protein or chimeric protein complex can be administered sequentially. The term "sequentially" as used herein means that the additional therapeutic agent and the chimeric protein or chimeric protein complex are administered with a time separation of more than about 60 minutes. For example, the time between the sequential administration of the additional therapeutic agent and the chimeric protein or chimeric protein complex can be more than about 60 minutes, more than about 2 hours, more than about 5 hours, more than about 10 hours, more than about 1 day, more than about 2 days, more than about 3 days, more than about 1 week apart, more than about 2 weeks apart, or more than about one month apart. The optimal administration times will depend on the rates of metabolism, excretion, and/or the pharmacodynamic activity of the additional therapeutic agent and the chimeric protein or chimeric protein complex being administered. Either the additional therapeutic agent or the chimeric protein or chimeric protein complex cell may be administered first.

Co-administration also does not require the therapeutic agents to be administered to the subject by the same route of administration. Rather, each therapeutic agent can be administered by any appropriate route, for example, parenterally or non-parenterally.

In some embodiments, the Clec4C binding agent described herein acts synergistically when co-administered with another therapeutic agent. In such embodiments, the Clec4C binding agent and the additional therapeutic agent may be administered at doses that are lower than the doses employed when the agents are used in the context of monotherapy.

In some embodiments, the present invention pertains to chemotherapeutic agents as additional therapeutic agents. For example, without limitation, such combination of the present Clec4C binding agents and chemotherapeutic agent find use in the treatment of cancers, as described elsewhere herein. Examples of chemotherapeutic agents include, but are not limited to, alkylating agents such as thiotepa and CYTOXAN cyclosphosphamide; alkyl sulfonates such as busulfan, improsulfan and piposulfan; aziridines such as benzodopa, carboquone, meturedopa, and uredopa; ethylenimines and methylamelamines including altretamine, triethylenemelamine, trietylenephosphoramide, triethiylenethiophosphoramide and trimethylolomelamine; acetogenins (e.g., bullatacin and bullatacinone); a camptothecin (including the synthetic analogue topotecan); bryostatin; callystatin; CC-1065 (including its adozelesin, carzelesin and bizelesin synthetic analogues); cryptophycins (e.g., cryptophycin 1 and cryptophycin 8); dolastatin; duocarmycin (including the synthetic analogues, KW-2189 and CB 1-TM1); eleutherobin; pancratistatin; a sarcodictyin; spongistatin; nitrogen mustards such as chlorambucil, chlornaphazine, cholophosphamide, estramustine, ifosfamide, mechlorethamine, mechlorethamine oxide hydrochloride, melphalan, novembichin, phenesterine, prednimustine, trofosfamide, uracil mustard; nitrosureas such as carmustine, chlorozotocin, fotemustine, lomustine, nimustine, and ranimnustine; antibiotics such as the enediyne antibiotics (e.g., calicheamicin, especially calicheamicin gammaII and calicheamicin omegaII (see, e.g., Agnew, Chem. Intl. Ed. Engl., 33: 183-186 (1994)); dynemicin, including dynemicin A; bisphosphonates, such as clodronate; an esperamicin; as well as neocarzinostatin chromophore and related chromoprotein enediyne antibiotic chromophores), aclacinomysins, actinomycin, authramycin, azaserine, bleomycins, cactinomycin, carabicin, caminomycin, carzinophilin, chromomycinis, dactinomycin, daunorubicin, detorubicin, 6-diazo-5-oxo-L-norleucine, ADRIAMYCIN doxorubicin (including morpholino-doxorubicin, cyanomorpholino-doxorubicin, 2-pyrrolino-doxorubicin and deoxy doxorubicin), epirubicin, esorubicin, idarubicin, marcellomycin, mitomycins such as mitomycin C, mycophenolic acid, nogalamycin, olivomycins, peplomycin, potfiromycin, puromycin, quelamycin, rodorubicin, streptonigrin, streptozocin, tubercidin, ubenimex, zinostatin, zorubicin; anti-metabolites such as methotrexate and 5-fluorouracil (5-FU); folic acid analogues such as denopterin, methotrexate, pteropterin, trimetrexate; purine analogs such as fludarabine, 6-mercaptopurine, thiamiprine, thioguanine; pyrimidine analogs such as ancitabine, azacitidine, 6-azauridine, carmofur, cytarabine, dideoxyuridine, doxifluridine, enocitabine, floxuridine; androgens such as calusterone, dromostanolone propionate, epitiostanol, mepitiostane, testolactone; anti-adrenals such as minoglutethimide, mitotane, trilostane; folic acid replenisher such as frolinic acid; aceglatone; aldophosphamide glycoside; aminolevulinic acid; eniluracil; amsacrine; bestrabucil; bisantrene; edatraxate; demecolcine; diaziquone; elformithine; elliptinium acetate; an epothilone; etoglucid; gallium nitrate; hydroxyurea; lentinan; lonidainine; maytansinoids such as maytansine and ansamitocins; mitoguazone; mitoxantrone; mopidanmol; nitraerine; pentostatin; phenamet; pirarubicin; losoxantrone; podophyllinic acid; 2-ethylhydrazide; procarbazine; PSK polysaccharide complex (JHS Natural Products, Eugene, Oreg.); razoxane; rhizoxin; sizofuran; spirogermanium; tenuazonic acid; triaziquone; 2,2',2''-trichlorotriethylamine; trichothecenes (e.g., T-2 toxin, verracurin A, roridin A and anguidine); urethan; vindesine; dacarbazine; mannomustine; mitobronitol; mitolactol; pipobroman; gacytosine; arabinoside ("Ara-C"); cyclophosphamide; thiotepa; taxoids, e.g., TAXOL paclitaxel (Bristol-Myers Squibb Oncology, Princeton, N.J.), ABRAXANE Cremophor-free, albumin-engineered nanoparticle formulation of paclitaxel (American Pharmaceutical Partners, Schaumberg, 111), and TAXOTERE doxetaxel (Rhone-Poulenc Rorer, Antony, France); chloranbucil; GEMZAR gemcitabine; 6-thioguanine; mercaptopurine; methotrexate; platinum analogs such as cisplatin, oxaliplatin and carboplatin; vinblastine; platinum; etoposide (VP-16); ifosfamide; mitoxantrone; vincristine; NAVELBINE. vinorelbine; novantrone; teniposide; edatrexate; daunomycin; aminopterin; xeloda; ibandronate; irinotecan (Camptosar, CPT-11) (including the treatment regimen of irinotecan with 5-FU and leucovorin); topoisomerase inhibitor RFS 2000; difluoromethylornithine (DMFO); retinoids such as retinoic acid; capecitabine; combretastatin; leucovorin (LV); oxaliplatin, including the oxaliplatin treatment regimen (FOLFOX); lapatinib (Tykerb); inhibitors of PKC-α, Raf, H-Ras, EGFR (e.g., erlotinib (Tarceva)) and VEGF-A that reduce cell proliferation and pharmaceutically acceptable salts, acids or derivatives of any of the above. In addition, the methods of treatment can further include the use of radiation. In addition, the methods of treatment can further include the use of photodynamic therapy.

Accordingly, in some embodiments, the present invention relates to combination therapies using the Clec4C binding agent and a chemotherapeutic agent. In some embodiments, the present invention relates to administration of the Clec4C binding agent to a patient undergoing treatment with a chemotherapeutic agent. In some embodiments, the chemotherapeutic agent is a DNA-intercalating agent such as, without limitation, doxorubicin, cisplatin, daunorubicin, and epirubicin. In an embodiment, the DNA-intercalating agent is doxorubicin.

In illustrative embodiments, the Clec4C binding agent acts synergistically when co-administered with doxorubicin. In an illustrative embodiment, the Clec4C binding agent acts synergistically when co-administered with doxorubicin for use in treating tumor or cancer. For example, co-administration of the Clec4C binding agent and doxorubicin may act synergistically to reduce or eliminate the tumor or cancer, or slow the growth and/or progression and/or metastasis of the tumor or cancer. In illustrative embodiments, the combination of the Clec4C binding agent and doxorubicin may exhibit improved safety profiles when compared to the agents used alone in the context of monotherapy. In illustrative embodiments, the Clec4C binding agent and doxorubicin may be administered at doses that are lower than the doses employed when the agents are used in the context of monotherapy. In some embodiments, the Clec4C binding agent comprises a mutated interferon such as a mutated IFNα. In illustrative embodiments, the mutated IFN-α2 comprises one or more mutations at positions 148, 149, and 153 with reference to SEQ ID NO: 46 or SEQ ID NO: 47, such as the substitutions M148A, R149A, and L153A.

In some embodiments, the present invention relates to combination therapy with one or more immune-modulating agents, for example, without limitation, agents that modulate immune checkpoint. In various embodiments, the immune-modulating agent targets one or more of PD-1, PD-L1, and PD-L2. In various embodiments, the immune-modulating agent is PD-1 inhibitor. In various embodiments, the immune-modulating agent is an antibody specific for one or more of PD-1, PD-L1, and PD-L2. For instance, in some embodiments, the immune-modulating agent is an antibody such as, by way of non-limitation, nivolumab, (ONO-4538/BMS-936558, MDX1106, OPDIVO, BRISTOL MYERS SQUIBB), pembrolizumab (KEYTRUDA, MERCK), pidilizumab (CT-011, CURE TECH), MK-3475 (MERCK), BMS 936559 (BRISTOL MYERS SQUIBB), MPDL3280A (ROCHE). In some embodiments, the immune-modulating agent targets one or more of CD137 or CD137L. In various embodiments, the immune-modulating agent is an antibody specific for one or more of CD137 or CD137L. For instance, in some embodiments, the immune-modulating agent is an antibody such as, by way of non-limitation, urelumab (also known as BMS-663513 and anti-4-1BB antibody). In some embodiments, the present chimeric protein or chimeric protein complex is combined with urelumab (optionally with one or more of nivolumab, lirilumab, and urelumab) for the treatment of solid tumors and/or B-cell non-Hodgkins lymphoma and/or head and neck cancer and/or multiple myeloma. In some embodiments, the immune-modulating agent is an agent that targets one or more of CTLA-4, AP2M1, CD80, CD86, SHP-2, and PPP2R5A. In various embodiments, the immune-modulating agent is an antibody specific for one or more of CTLA-4, AP2M1, CD80, CD86, SHP-2, and PPP2R5A. For instance, in some embodiments, the immune-modulating agent is an antibody such as, by way of non-limitation, ipilimumab (MDX-010, MDX-101, Yervoy, BMS) and/or tremelimumab (Pfizer). In some embodiments, the present chimeric protein or chimeric protein complex is combined with ipilimumab (optionally with bavituximab) for the treatment of one or more of melanoma, prostate cancer, and lung cancer. In various embodiments, the immune-modulating agent targets CD20. In various embodiments, the immune-modulating agent is an antibody specific CD20. For instance, in some embodiments, the immune-modulating agent is an antibody such as, by way of non-limitation, Ofatumumab (GENMAB), obinutuzumab (GAZYVA), AME-133v (APPLIED MOLECULAR EVOLUTION), Ocrelizumab (GENENTECH), TRU-015 (TRUBION/EMERGENT), veltuzumab (IMMU-106).

In some embodiments, the present invention relates to combination therapy using the Clec4C binding agent and a checkpoint inhibitor. In some embodiments, the present invention relates to administration of the Clec4C binding agent to a patient undergoing treatment with a checkpoint inhibitor. In some embodiments, the checkpoint inhibitor is an agent that targets one or more of PD-1, PD-L1, PD-L2, and CTLA-4 (including any of the anti-PD-1, anti-PD-L1, anti-PD-L2, and anti-CTLA-4 agents described herein). In some embodiment, the checkpoint inhibitor is one or more of nivolumab, (ONO-4538/BMS-936558, MDX1106, OPDIVO, BRISTOL MYERS SQUIBB), pembrolizumab (KEYTRUDA, MERCK), pidilizumab (CT-011, CURE TECH), MK-3475 (MERCK), BMS 936559 (BRISTOL MYERS SQUIBB), MPDL3280A (ROCHE), ipilimumab (MDX-010, MDX-101, Yervoy, BMS) and tremelimumab (Pfizer). In an embodiment, the checkpoint inhibitor is an antibody against PD-L1.

In illustrative embodiments, the Clec4C binding agent acts synergistically when co-administered with the anti-PD-L1 antibody. In an illustrative embodiment, the Clec4C binding agent acts synergistically when co-administered with the anti-PD-L1 antibody for use in treating tumor or cancer. For example, co-administration of the Clec4C binding agent and the anti-PD-L1 antibody may act synergistically to reduce or eliminate the tumor or cancer, or slow the growth and/or progression and/or metastasis of the tumor or cancer. In some embodiments, the combination of the Clec4C binding agent and the anti-PD-L1 antibody may exhibit improved safety profiles when compared to the agents used alone in the context of monotherapy. In some embodiments, the Clec4C binding agent and the anti-PD-L1 antibody may be administered at doses that are lower than the doses employed when the agents are used in the context of monotherapy. In some embodiments, the Clec4C binding agent comprises a mutated interferon such as a mutated IFNα. In illustrative embodiments, the mutated IFNα comprises one or more mutations at positions 148, 149, and 153 with reference to SEQ ID NO: 337 or SEQ ID NO: 338, such as the substitutions M148A, R149A, and L153A.

In some embodiments, the present invention relates to combination therapies using the Clec4C binding agent and an immunosuppressive agent. In some embodiments, the present invention relates to administration of the Clec4C binding agent to a patient undergoing treatment with an immunosuppressive agent. In an embodiment, the immunosuppressive agent is TNF.

In illustrative embodiments, the Clec4C binding agent acts synergistically when co-administered with TNF. In an illustrative embodiment, the Clec4C binding agent acts synergistically when co-administered with TNF for use in treating tumor or cancer. For example, co-administration of the Clec4C binding agent and TNF may act synergistically to reduce or eliminate the tumor or cancer, or slow the growth and/or progression and/or metastasis of the tumor or cancer. In some embodiments, the combination of the Clec4C binding agent and TNF may exhibit improved safety profiles when compared to the agents used alone in the context of monotherapy. In some embodiments, the Clec4C binding agent and TNF may be administered at doses that are lower than the doses employed when the agents are used in the context of monotherapy. In some embodiments, the Clec4C binding agent comprises a mutated interferon such as a mutated IFNα. In illustrative embodiments, the mutated IFNα comprises one or more mutations at positions 148, 149, and 153 with reference to SEQ ID NO: 337 or SEQ ID NO: 338, such as the substitutions M148A, R149A, and L153A.

In some embodiments, the Clec4C binding agent acts synergistically when used in combination with Chimeric Antigen Receptor (CAR) T-cell therapy. In an illustrative embodiment, the Clec4C binding agent acts synergistically when used in combination with CAR T-cell therapy in treating tumor or cancer. In an embodiment, the Clec4C binding agent acts synergistically when used in combination with CAR T-cell therapy in treating blood-based tumors. In an embodiment, the Clec4C binding agent acts synergistically when used in combination with CAR T-cell therapy in treating solid tumors. For example, use of the Clec4C binding agent and CAR T-cells may act synergistically to reduce or eliminate the tumor or cancer, or slow the growth and/or progression and/or metastasis of the tumor or cancer. In various embodiments, the Clec4C binding agent of the invention induces CAR T-cell division. In various embodiments, the Clec4C binding agent of the invention induces CAR T-cell proliferation. In various embodiments, the Clec4C binding agent of the invention prevents anergy of the CAR T cells.

In various embodiments, the CAR T-cell therapy comprises CAR T cells that target antigens (e.g., tumor antigens) such as, but not limited to, carbonic anhydrase IX (CAIX), 5T4, CD19, CD20, CD22, CD27, CD30, CD33, CD38, CD47, CD70, CS1, CD138, Lewis-Y, L1-CAM, MUC16, ROR-1, IL13Rα2, gp100, prostate stem cell antigen (PSCA), prostate-specific membrane antigen (PSMA), B-cell maturation antigen (BCMA), human papillomavirus type 16 E6 (HPV-16 E6), CD171, folate receptor alpha (FR-α), GD2, human epidermal growth factor receptor 2 (HER2), mesothelin, EGFRvIII, fibroblast activation protein (FAP), carcinoembryonic antigen (CEA), and vascular endothelial growth factor receptor 2 (VEGF-R2), as well as other tumor antigens well known in the art. Additional illustrative tumor antigens include, but are not limited to MART-1/Melan-A, gp100, Dipeptidyl peptidase IV (DP-PIV), adenosine deaminase-binding protein (ADAbp), cyclophilin b, Colorectal associated antigen (CRC)-0017-1A/GA733, Carcinoembryonic Antigen (CEA) and its immunogenic epitopes CAP-1 and CAP-2, etv6, aml1, Prostate Specific Antigen (PSA) and its immunogenic epitopes PSA-1, PSA-2, and PSA-3, T-cell receptor/CD3-zeta chain, MAGE-family of tumor antigens (e.g., MAGE-A1, MAGE-A2, MAGE-A3, MAGE-A4, MAGE-A5, MAGE-A6, MAGE-A7, MAGE-A8, MAGE-A9, MAGE-A10, MAGE-A11, MAGE-A12, MAGE-Xp2 (MAGE-B2), MAGE-Xp3 (MAGE-B3), MAGE-Xp4 (MAGE-B4), MAGE-C1, MAGE-C2, MAGE-C3, MAGE-C4, MAGE-C5), GAGE-family of tumor antigens (e.g., GAGE-1, GAGE-2, GAGE-3, GAGE-4, GAGE-5, GAGE-6, GAGE-7, GAGE-8, GAGE-9), BAGE, RAGE, LAGE-1, NAG, GnT-V, MUM-1, CDK4, tyrosinase, p53, MUC family, HER2/neu, p21ras, RCAS1, α-fetoprotein, E-cadherin, α-catenin, β-catenin and γ-catenin, p120ctn, gp100 Pmel117, PRAME, NY-ESO-1, cdc27, adenomatous polyposis coli protein (APC), fodrin, Connexin 37, Ig-idiotype, p15, gp75, GM2 and GD2 gangliosides, viral products such as human papilloma virus proteins, Smad family of tumor antigens, Imp-1, NA, EBV-encoded nuclear antigen (EBNA)-1, brain glycogen phosphorylase, SSX-1, SSX-2 (HOM-MEL-40), SSX-1, SSX-4, SSX-5, SCP-1 CT-7, c-erbB-2, CD19, CD37, CD56, CD70, CD74, CD138, AGS16, MUC1, GPNMB, Ep-CAM, PD-L1, and PD-L2.

Illustrative CAR T-cell therapy include, but are not limited to, JCAR014 (Juno Therapeutics), JCAR015 (Juno Therapeutics), JCAR017 (Juno Therapeutics), JCAR018 (Juno Therapeutics), JCAR020 (Juno Therapeutics), JCAR023 (Juno Therapeutics), JCAR024 (Juno Therapeutics), CTL019 (Novartis), KTE-C19 (Kite Pharma), BPX-401 (Bellicum Pharmaceuticals), BPX-501 (Bellicum Pharmaceuticals), BPX-601 (Bellicum Pharmaceuticals), bb2121 (Bluebird Bio), CD-19 Sleeping Beauty cells (Ziopharm Oncology), UCART19 (Cellectis), UCART123 (Cellectis), UCART38 (Cellectis), UCARTCS1 (Cellectis), OXB-302 (Oxford BioMedica, MB-101 (Mustang Bio) and CAR T-cells developed by Innovative Cellular Therapeutics.

In some embodiments, the Clec4C binding agent is used in a method of treating multiple sclerosis (MS) in combination with one or more MS therapeutics including, but not limited to, 3-interferons, L acetate, T-interferon, IFN-β-2 (U.S. Patent Publication No. 2002/0025304), spirogermaniums (e.g., N-(3-dimethylaminopropyl)-2-aza-8,8-dimethyl-8-germanspiro [4:5] decane, N-(3-dimethylaminopropyl)-2-aza-8,8-diethyl-8-germaspiro [4:5]decane, N-(3-dimethylaminopropyl)-2-aza-8,8-dipropyl-8-germaspiro [4:5] decane, and N-(3-dimethylaminopropyl)-2-aza-8,8-dibutyl-8-germaspiro [4:5] decane), vitamin D analogs (e.g., 1,25 (OH) 2D3, (see, e.g., U.S. Pat. No. 5,716,946)), prostaglandins (e.g., latanoprost, brimonidine, PGE1, PGE2 and PGE3, see, e.g., U.S. Patent Publication No. 2002/0004525), tetracycline and derivatives (e.g., minocycline and doxycycline, see, e.g., U.S. Patent Publication No. 20020022608), a VLA-4 binding antibody (see, e.g., U.S. Patent Publication No. 2009/0202527), adrenocorticotrophic hormone, corticosteroid, prednisone, methylprednisone, 2-chlorodeoxyadenosine, mitoxantrone, sulphasalazine, methotrexate, azathioprine, cyclophosphamide, cyclosporin, fumarate, anti-CD20 antibody (e.g., rituximab), and tizanidine hydrochloride.

In some embodiments, the Clec4C binding agent is used in combination with one or more therapeutic agents that treat one or more symptoms or side effects of MS. Such agents include, but are not limited to, amantadine, baclofen, papaverine, meclizine, hydroxyzine, sulfamethoxazole, ciprofloxacin, docusate, pemoline, dantrolene, desmopressin, dexamethasone, tolterodine, phenyloin, oxybutynin, bisacodyl, venlafaxine, amitriptyline, methenamine, clonazepam, isoniazid, vardenafil, nitrofurantoin, psyllium hydrophilic mucilloid, alprostadil, gabapentin, nortriptyline, paroxetine, propantheline bromide, modafinil, fluoxetine, phenazopyridine, methylprednisolone, carbamazepine, imipramine, diazepam, sildenafil, bupropion, and sertraline.

In some embodiments, the Clec4C binding agent is used in a method of treating multiple sclerosis in combination with one or more of the disease modifying therapies (DMTs) described herein (e.g. the agents of Table 6). In some embodiments, the present invention provides an improved therapeutic effect as compared to use of one or more of the DMTs described herein (e.g. the agents listed in the Table 6 below) without the one or more disclosed binding agent. In an embodiment, the combination of the Clec4C binding agent and the one or more DMTs produces synergistic therapeutic effects.

TABLE 6

Illustrative Disease Modifying Therapies

| Generic Name | Branded Name/Company | Frequency/Route of Delivery/Usual Dose |
| --- | --- | --- |
| teriflunomide | AUBAGIO (GENZYME) | Every day; pill taken orally; 7 mg or 14 mg. |
| interferon beta-1a | AVONEX (BIOGEN IDEC) | Once a week; intramuscular (into the muscle) injection; 30 mcg |
| interferon beta-1b | BETASERON (BAYER HEALTHCARE PHARMACEUTICALS, INC.) | Every other day; subcutaneous (under the skin) injection; 250 mcg. |
| glatiramer acetate | COPAXONE (TEVA NEUROSCIENCE) | Every day; subcutaneous (under the skin) injection; 20 mg (20,000 mcg) OR Three times a week; subcutaneous (under the skin) injection; 40 mg (40,000 mcg) |
| interferon beta-1b | EXTAVIA (NOVARTIS PHARMACEUTICALS CORP.) | Every other day; subcutaneous (under the skin) injection; 250 mcg. |
| fingolimod | GILENYA (NOVARTIS PHARMACEUTICALS CORP.) | Every day; capsule taken orally; 0.5 mg. |
| Alemtuzumab (anti-CD52 monoclonal antibody) | LEMTRADA (GENZYME) | Intravenous infusion on five consecutive days, followed by intravenous infusion on three consecutive days one year later (12 mg) |
| mitoxantrone | NOVANTRONE (EMD SERONO) | Four times a year by IV infusion in a medical facility. Lifetime cumulative dose limit of approximately 8-12 doses over 2-3 years (140 mg/m2). |
| pegylated interferon beta-1a | PLEGRIDY (BIOGEN IDEC) | Every 14 days; subcutaneous (under the skin) injection; 125 mcg |
| interferon beta-1a | REBIF (EMD SERONO, INC.) | Three times a week; subcutaneous (under the skin) injection; 44 mcg |
| dimethyl fumarate (BG-12) | TECFIDERA (BIOGEN IDEC) | Twice a day; capsule taken orally; 120 mg for one week and 240 mg therafter |
| Natalizumab (humanized monoclonal antibody VLA-4 antagonist) | TYSABRI (BIOGEN IDEC) | Every four weeks by IV infusion in a registered infusion facility; 300 mg |
| DMTs in Development | | |
| Amiloride (targets Acid-sensing ion channel-1 Epithelial sodium channel Na+/H+ exchanger) | PAR PHARMACEUTICAL, PERRIGO COMPANY, SIGMAPHARM LABORATORIES | Oral |
| ATX-MS-1467 (targets Major histocompatibility complex class II T cell responses to myelin basic protein) | APITOPE/MERCK SERONO | Intradermal Subcutaneous |
| BAF312 (targets Sphingosine 1-phosphate (S1P) receptor subtypes S1P1 and S1P5B cell distrubution T cell distribution) | NOVARTIS PHARMA | Oral |
| BGC20-0134 (targets Proinflammatory and anti-inflammatory cytokines) | BTG PLC | Oral |
| BIIB033 (targets LINGO-1 ("leucine-rich repeat and immunoglobulin-like domain-containing, Nogo receptor-interacting protein")) | BIOGEN | Intravenous infusion used in Phase I and Phase II trials Subcutaneous injection used in Phase I trial |

TABLE 6-continued

Illustrative Disease Modifying Therapies

| Generic Name | Branded Name/Company | Frequency/Route of Delivery/Usual Dose |
| --- | --- | --- |
| Cladribine (targets CD4+ T cells DNA synthesis and repair E-selectin Intracellular adhesion molecule-1 Pro-inflammatory cytokines interleukin 2 and interleukin 2R Pro-inflammatory cytokines interleukin 8 and RANTES Cytokine secretion Monocyte and lymphocyte migration) | MERCK SERONO | Oral |
| Cyclophosphamide (targets T cells, particularly CD4+ helper T cells B cells) | BAXTER HEALTHCARE CORPORATION | Oral, monthly intravenous pulses |
| Daclizumab (humanized monoclonal antibody targeting CD25 Immune modulator of T cells) | BIOGEN IDEC/ABBVIE BIOTHERAPEUTICS | Projected to be IM injection once monthly |
| Dalfampridine (targets Voltage-gated potassium channels Degenerin/epithelial sodium channels L-type calcium channels that contain subunit Cavbeta3) | ACORDA THERAPEUTICS/ BIOGEN IDEC | One tablet every 12 hours (extended release), 10 mg twice a day |
| Dronabinol (targets Cannabinoid receptor CB1 Cannabinoid receptor CB2) | ABBVIE INC. | Oral |
| Firategrast (targets Alpha4beta1 integrin) | GLAXOSMITHKLINE | Oral |
| GNbAC1MSRV-Env (targets envelope protein of the MS-associated retrovirus) | GENEURO SA/SERVER | Intravenous infusion |
| Idebenone (targets Reactive oxygen species) | SANTHERA PHARMACEUTICALS | Oral Dose in clinical trial for PPMS is 2250 mg per day (750 mg dose, 3 times per day) |
| Imilecleucel-T (targets Myelin-specific, autoreactive T cells) | OPEXA THERAPEUTICS/ MERCK SERONO | Subcutaneous Given 5 times per year, according to information from the manufacturer |
| Laquinimod | TEVA | Projected to be 0.6 mg or 1.2 mg oral tablet taken daily |
| Masitinib (targets KIT (a stem cell factor, also called c-KIT) receptor as well as select other tyrosine kinases Mast cells) | AB SCIENCE | Oral |
| MEDI-551 (targets CD19, a B cell-specific antigen that is part of the B cell receptor complex and that functions in determining the threshold for B cell activation B cells Plasmablasts, B cells that express CD19 (but not CD20) and that secrete large quantities of antibodies; depletion of plasmablasts may be useful in autoimmune diseases involving pathogenic autoantibodies) | MEDIMMUNE | Intravenous Subcutaneous |
| Minocycline (targets T cells Microglia Leukocyte migration Matrix metalloproteinases) | VARIOUS | Oral Available as pellet-filled capsules and an oral suspension |
| MIS416 (targets Innate immune system Pathogen-associated molecular pattern recognition receptors of the innate immune system Myeloid cells of the innate immune system, which might be able to remodel the deregulated immune system activity that occurs in SPMS) | INNATE IMMUNOTHERAPEUTICS | Intravenous |

TABLE 6-continued

Illustrative Disease Modifying Therapies

| Generic Name | Branded Name/Company | Frequency/Route of Delivery/Usual Dose |
|---|---|---|
| Mycophenolate mofetil (targets Purine synthesis) | MANUFACTURED BY GENENTECH | Oral |
| Naltrexone (targets Opioid receptors Toll-like receptor 4) | VARIOUS | Given at low doses (3 to 4.5 mg per day) in oral form as "Low-dose naltrexone" (or "LDN") |
| Ocrelizumab and Ofatumumab (humanized monoclonal antibodies targeting CD20 B cell suppression | ROCHE/GSK | Projected to be IV infusion |
| ONO-4641 (targets Sphingosine 1-phosphate receptor) | ONO PHARMACEUTICAL CO. | Oral |
| Phenytoin (targets Sodium channels) | PFIZER | Intravenous Intramuscular (less favored option) Oral |
| Ponesimod | ACTELION | To be determined |
| Raltegravir (targets Retroviral integrase Herpesvirus DNA packaging terminase) | MERCK | Oral 400 mg tablet twice daily, according to information from the manufacturer |
| RHB-104 | REDHILL BIOPHARMA LIMITED | 95 mg clarithromycin, 45 mg rifabutin, and 10 mg clofazimine |
| Riluzole (targets Glutamatergic neurotransmission Glutamate uptake and release Voltage-gated sodium channels Protein kinase C) | COVIS PHARMA/SANOFI | Oral |

MS disease progression may be most intensive, and most damaging, at the earliest stages of disease progression. Accordingly, counter to many reimbursement policies and physician practice in light of, for example, costs and side effect mitigation, it may be most beneficial for a patient's long term disease status to begin treatment with the most intensive DMTs, for instance so-called second-line therapies. In some embodiments, a patient is treated with a regimen of the Clec4C binding agent in combination with a second-line therapy. Such a combination is used to reduce the side effect profile of one or more second-line therapies. In some embodiments, the combination is used to reduce dose of frequency of administration of one or more second-line therapies. For example, the doses of agents listed in Table 6 provided above may be reduced by about 50%, or about 40%, or about 30%, or about 25% in the context of the combination and the/or the frequency of dosing may be decreased to be half as often, or a third as often or may be reduced from, for example, daily to every other day or weekly, every other day to weekly or bi-weekly, weekly to bi-weekly or monthly, etc. Accordingly, in some embodiments, the Clec4C binding agent increase patient adherence by allowing for more convenient treatment regimens. Further, some DMTs have a suggested lifetime dose limitation e.g. for mitoxantrone, the lifetime cumulative dose should be strictly limited to 140 mg/m$^2$, or 2 to 3 years of therapy. In some embodiments, supplementation with the Clec4C binding agent preserves patient's access to mitoxantrone by allowing for lower or less frequent dosing with this DMT.

In some embodiments, the patient is a naive patient, who has not received treatment with one or more DMTs, and the Clec4C binding agent is used to buffer the side effects of a second-line therapy. Accordingly, the naive patient is able to benefit from the long-term benefits of a second-line therapy at disease outset. In some embodiments, the Clec4C binding agent is used as an entry therapy that precedes the use of a second-line therapy. For example, the Clec4C binding agent may be administered for an initial treatment period of about 3 months to stabilize disease and then the patient may be transitioned to a maintenance therapy of a second line agent.

It is generally believed that naive patients are more likely to respond to therapy as compared to patients that have received, and perhaps failed one or more DMT. In some embodiments, the Clec4C binding agent finds use in patients that have received, and perhaps failed one or more DMT. For example, in some embodiments, the Clec4C binding agent increases the therapeutic effect in patients that have received, and perhaps failed one or more DMT and may allow these patients to respond like naive patients.

In some embodiments, the patient has received or is receiving treatment with one or more DMTs and is not responding well. For example, the patient may be refractory or poorly responsive to one or more DMTs. In some embodiments, the patient is refractory, or poorly responsive to one or more of teriflunomide (AUBAGIO (GENZYME)); interferon beta-1a (AVONEX (BIOGEN IDEC); interferon beta-1b (BETASERON (BAYER HEALTHCARE PHARMACEUTICALS, INC.); glatiramer acetate (COPAXONE (TEVA NEUROSCIENCE); interferon beta-1b (EXTAVIA (NOVARTIS PHARMACEUTICALS CORP.); fingolimod (GILENYA (NOVARTIS PHARMACEUTICALS CORP.); alemtuzumab (LEMTRADA (GENZYME); mitoxantrone (NOVANTRONE (EMD SERONO); pegylated interferon beta-1a (PLEGRIDY (BIOGEN IDEC); interferon beta-1a (REBIF (EMD SERONO, INC.); dimethyl fumarate (BG-12) (TECFIDERA (BIOGEN IDEC); and natalizumab (TYSABRI (BIOGEN IDEC). In some embodiments, the one or more disclosed binding agent results in a therapeutic benefit of one or more DMTs in the patient and therefore reduces or eliminates the non-responsiveness to the DMT. For instance, this may spare the patient therapy with one or more DMTs at a higher dosing or frequency.

In patients with more aggressive disease, one approach is an induction treatment model, where a therapy with strong efficacy but strong safety concerns would be given first, followed by a maintenance therapy. An example of such a model might include initial treatment with alemtuzumab, followed by IFN-β, GA, or BG-12. In some embodiments, the one or more disclosed binding agent is used to prevent the need to switch therapies for maintenance. In some embodiments, the one or more disclosed binding agent is used to as maintenance therapy to one or more DMTs, including second line therapies. In some embodiments, the one or more disclosed binding agent is used to as first therapy in an induction, followed by another DMT as a maintenance therapy—such as, for example, a first line therapy.

In some embodiments, the one or more disclosed binding agent may be administered for an initial treatment period of about 3 months to stabilize disease and then the patient may be transitioned to a maintenance therapy of a first line agent.

In various embodiments, the one or more disclosed binding agent is used to reduce one or more side effects of a DMT, including without limitation any agent disclosed herein. For example, the one or more disclosed binding agent may be used in a regimen that allows dose sparing for one or more DMTs and therefore results in fewer side effects. For example, in some embodiments, the one or more disclosed binding agent may reduce one or more side effects of AUBAGIO or related agents, which may include hair thinning, diarrhea, flu, nausea, abnormal liver tests and unusual numbness or tingling in the hands or feet (paresthesias), levels of white blood cells, which can increase the risk of infections; increase in blood pressure; and severe liver damage. In some embodiments, the one or more disclosed binding agent may reduce one or more side effects of AVONEX or related agents which include flu-like symptoms following injection, depression, mild anemia, liver abnormalities, allergic reactions, and heart problems. In some embodiments, the one or more disclosed binding agent may reduce one or more side effects of BETASERON or related agents which include flu-like symptoms following injection, injection site reactions, allergic reactions, depression, liver abnormalities, and low white blood cell counts. In some embodiments, the one or more disclosed binding agent may reduce one or more side effects of COPAXONE or related agents which include injection site reactions, vasodilation (dilation of blood vessels); chest pain; a reaction immediately after injection, which includes anxiety, chest pain, palpitations, shortness of breath, and flushing. In some embodiments, the one or more disclosed binding agent may reduce one or more side effects of EXTAVIA or related agents which include flu-like symptoms following injection, injection site reactions, allergic reactions, depression, liver abnormalities, and low white blood cell counts. In some embodiments, the one or more disclosed binding agent may reduce one or more side effects of GILENYA or related agents which include headache, flu, diarrhea, back pain, liver enzyme elevations, cough, slowed heart rate following first dose, infections, and swelling in the eye. In some embodiments, the one or more disclosed binding agent may reduce one or more side effects of LEMTRADA or related agents which include rash, headache, fever, nasal congestion, nausea, urinary tract infection, fatigue, insomnia, upper respiratory tract infection, hives, itching, thyroid gland disorders, fungal Infection, pain in joints, extremities and back, diarrhea, vomiting, flushing, and infusion reactions (including nausea, hives, itching, insomnia, chills, flushing, fatigue, shortness of breath, changes in the sense of taste, indigestion, dizziness, pain). In some embodiments, the one or more disclosed binding agent may reduce one or more side effects of NOVANTRONE or related agents which include blue-green urine 24 hours after administration; infections, bone marrow suppression (fatigue, bruising, low blood cell counts), nausea, hair thinning, bladder infections, mouth sores, and serious liver and heart damage. In some embodiments, the one or more disclosed binding agent may reduce one or more side effects of PLEGRIDY or related agents which include flu-like symptoms following injection, injection site reactions, depression, mild anemia, liver abnormalities, allergic reactions, and heart problems. In some embodiments, the one or more disclosed binding agent may reduce one or more side effects of REBIF or related agents which include flu-like symptoms following injection, injection site reactions, liver abnormalities, depression, allergic reactions, and low red or white blood cell counts. In some embodiments, one or more disclosed binding agent may reduce one or more side effects of TECFIDERA or related agents which include flushing (sensation of heat or itching and a blush on the skin), gastrointestinal issues (nausea, diarrhea, abdominal pain), rash, protein in the urine, elevated liver enzymes; and reduction in blood lymphocyte (white blood cell) counts. In some embodiments, the one or more disclosed binding agent may reduce one or more side effects of TYSABRI or related agents which include headache, fatigue, urinary tract infections, depression, respiratory tract infections, joint pain, upset stomach, abdominal discomfort, diarrhea, vaginitis, pain in the arms or legs, rash, allergic or hypersensitivity reactions within two hours of infusion (dizziness, fever, rash, itching, nausea, flushing, low blood pressure, difficulty breathing, chest pain).

In an embodiment, the present invention relates to any agent that targets the spliceosome, including any component of the spliceosome, as additional therapeutic agents in the treatment of cancer.

In an embodiment, the present invention relates to any agent that targets Myc (i.e., anti-Myc therapeutics) as additional therapeutic agents in the treatment of cancer.

In some embodiments, inclusive of, without limitation, infectious disease applications, the present invention pertains to anti-infectives as additional therapeutic agents. In some embodiments, the anti-infective is an anti-viral agent including, but not limited to, Abacavir, Acyclovir, Adefovir, Amprenavir, Atazanavir, Cidofovir, Darunavir, Delavirdine, Didanosine, Docosanol, Efavirenz, Elvitegravir, Emtricitabine, Enfuvirtide, Etravirine, Famciclovir, and Foscarnet. In some embodiments, the anti-infective is an anti-bacterial agent including, but not limited to, cephalosporin antibiotics (cephalexin, cefuroxime, cefadroxil, cefazolin, cephalothin, cefaclor, cefamandole, cefoxitin, cefprozil, and ceftobiprole); fluoroquinolone antibiotics (cipro, Levaquin, floxin, tequin, avelox, and norflox); tetracycline antibiotics (tetracycline, minocycline, oxytetracycline, and doxycycline); penicillin antibiotics (amoxicillin, ampicillin, penicillin V, dicloxacillin, carbenicillin, vancomycin, and methicillin); monobactam antibiotics (aztreonam); and carbapenem antibiotics (ertapenem, doripenem, imipenem/cilastatin, and meropenem). In some embodiments, the anti-infectives include anti-malarial agents (e.g., chloroquine, quinine, mefloquine, primaquine, doxycycline, artemether/lumefantrine, atovaquone/proguanil and sulfadoxine/pyrimethamine), metronidazole, tinidazole, ivermectin, pyrantel pamoate, and albendazole.

In some embodiments, inclusive, without limitation, of autoimmune applications, the additional therapeutic agent is an immunosuppressive agent. In some embodiments, the immunosuppressive agent is an anti-inflammatory agent such as a steroidal anti-inflammatory agent or a non-steroidal anti-inflammatory agent (NSAID). Steroids, particularly the adrenal corticosteroids and their synthetic analogues, are well known in the art. Examples of corticosteroids useful in the present invention include, without limitation, hydroxyltriamcinolone, alpha-methyl dexamethasone, beta-methyl betamethasone, beclomethasone dipropionate, betamethasone benzoate, betamethasone dipropionate, betamethasone valerate, clobetasol valerate, desonide, desoxymethasone, dexamethasone, diflorasone diacetate, diflucortolone valerate, fluadrenolone, fluclorolone acetonide, flumethasone pivalate, fluosinolone acetonide, fluocinonide, flucortine butylester, fluocortolone, fluprednidene (fluprednylidene) acetate, flurandrenolone, halcinonide, hydrocortisone acetate, hydrocortisone butyrate, methylprednisolone, triamcinolone acetonide, cortisone, cortodoxone, flucetonide, fludrocortisone, difluorosone diacetate, fluradrenolone acetonide, medrysone, amcinafel, amcinafide, betamethasone and the balance of its esters, chloroprednisone, clocortelone, clescinolone, dichlorisone, difluprednate, flucloronide, flunisolide, fluoromethalone, fluperolone, fluprednisolone, hydrocortisone, meprednisone, paramethasone, prednisolone, prednisone, beclomethasone dipropionate. (NSAIDS) that may be used in the present invention, include but are not limited to, salicylic acid, acetyl salicylic acid, methyl salicylate, glycol salicylate, salicylmides, benzyl-2,5-diacetoxybenzoic acid, ibuprofen, fulindac, naproxen, ketoprofen, etofenamate, phenylbutazone, and indomethacin. In some embodiments, the immunosupressive agent may be cytostatics such as alkylating agents, antimetabolites (e.g., azathioprine, methotrexate), cytotoxic antibiotics, antibodies (e.g., basiliximab, daclizumab, and muromonab), anti-immunophilins (e.g., cyclosporine, tacrolimus, sirolimus), inteferons, opioids, TNF binding proteins, mycophenolates, and small biological agents (e.g., fingolimod, myriocin). Additional anti-inflammatory agents are described, for example, in U.S. Pat. No. 4,537,776, the entire contents of which is incorporated by reference herein.

In some embodiments, the present invention pertains to various agents used for treating obesity as additional therapeutic agents. Illustrative agents used for treating obesity include, but are not limited to, orlistat (e.g. ALL1, XENICAL), loracaserin (e.g. BELVIQ), phentermine-topiramate (e.g. QSYMIA), sibutramme (e.g. REDUCTIL or MERJDIA), rimonabant (ACOMPLLA), exenatide (e.g. BYETTA), pramlintide (e.g. SYMLIN) phentermine, benzphetamine, diethylpropion, phendimetrazme, bupropion, and metformin. Agents that interfere with the body's ability to absorb specific nutrients in food are among the additional agents, e.g. orlistat (e.g. ALU, XENICAL), glucomannan, and guar gum. Agents that suppress apetite are also among the additional agents, e.g. catecholamines and their derivatives (such as phenteimine and other amphetamine-based drugs), various antidepressants and mood stabilizers (e.g. bupropion and topiramate), anorectics (e.g. dexedrine, digoxin). Agents that increase the body's metabolism are also among the additional agents.

In some embodiments, additional therapeutic agents may be selected from among appetite suppressants, neurotransmitter reuptake inhibitors, dopaminergic agonists, serotonergic agonists, modulators of GABAergic signaling, anticonvulsants, antidepressants, monoamine oxidase inhibitors, substance P (NK1) receptor antagonists, melanocortin receptor agonists and antagonists, lipase inhibitors, inhibitors of fat absorption, regulators of energy intake or metabolism, cannabinoid receptor modulators, agents for treating addiction, agents for treating metabolic syndrome, peroxisome proliferator-activated receptor (PPAR) modulators; dipeptidyl peptidase 4 (DPP-4) antagonists, agents for treating cardiovascular disease, agents for treating elevated triglyceride levels, agents for treating low HDL, agents for treating hypercholesterolemia, and agents for treating hypertension. Some agents for cardiovascular disease include statins (e.g. lovastatin, atorvastatin, fluvastatin, rosuvastatin, simvastatin and pravastatin) and omega-3 agents (e.g. LOVAZA, EPANQVA, VASCEPA, esterified omega-3's in general, fish oils, krill oils, algal oils). In some embodiments, additional agents may be selected from among amphetamines, benzodiazepines, sulfonyl ureas, meglitinides, thiazolidinediones, biguanides, beta-blockers, XCE inhibitors, diuretics, nitrates, calcium channel blockers, phenlermine, sibutramine, iorcaserin, cetilistat, rimonabant, taranabant, topiramate, gabapentin, valproate, vigabatrin, bupropion, tiagabine, sertraline, fluoxetine, trazodone, zonisamide, methylphenidate, varenicline, naltrexone, diethylpropion, phendimetrazine, rcpaglini.de, nateglinide, glimepiride, metformin, pioglitazone, rosiglilazone, and sitagliptin.

In some embodiments, the present invention pertains to an agent used for treating diabetes as additional therapeutic agents. Illustrative anti-diabetic agents include, but are not limited to, sulfonylurea (e.g. DYMELOR (acetohexamide), DIABINESE (chlorpropamide), ORINASE (tolbutamide), and TOLINASE (tolazamide), GLUCOTROL (glipizide), GLUCOTROL XL (extended release), DIABETA (glyburide), MICRONASE (glyburide), GLYNASE PRESTAB (glyburide), and AMARYL (glimepiride)); a Biguanide (e.g. metformin (GLUCOPHAGE, GLUCOPHAGE XR, RIOMET, FORTAMET, and GLUMETZA)); a thiazolidinedione (e.g. ACTOS (pioglitazone) and AVANDIA (rosiglitazone); an alpha-glucosidase inhibitor (e.g., PRECOSE (acarbose) and GLYSET (miglitol); a Meglitinide (e.g., PRANDIN (repaglinide) and STARLIX (nateglinide)); a Dipeptidyl peptidase IV (DPP-IV) inhibitor (e.g., JANUVIA (sitagliptin), NESINA (alogliptin), ONGLYZA (saxagliptin), and TRADJENTA (linagliptin)); Sodium-glucose co-transporter 2 (SGLT2) inhibitor (e.g. INVOKANA (canaglifozin)); and a combination pill (e.g. GLUCOVANCE, which combines glyburide (a sulfonylurea) and metformin, METAGLIP, which combines glipizide (a sulfonylurea) and metformin, and AVANDAMET, which uses both metformin and rosiglitazone (AVANDIA) in one pill, KAZANO (alogliptin and metformin), OSENI (alogliptin plus pioglitazone), METFORMIN oral, ACTOS oral, BYETTA subcutaneous, JANUVIA oral, WELCHOL oral, JANUMET oral, glipizide oral, glimepiride oral, GLUCOPHAGE oral, LANTUS subcutaneous, glyburide oral, ONGLYZA oral, AMARYI oral, LANTUS SOLOSTAR subcutaneous, BYDUREON subcutaneous, LEVEMIR FLEXPEN subcutaneous, ACTOPLUS MET oral, GLUMETZA oral, TRADJENTA oral, bromocriptine oral, KOMBIGLYZE XR oral, INVOKANA oral, PRANDIN oral, LEVEMIR subcutaneous, PARLODEL oral, pioglitazone oral, NOVOLOG subcutaneous, NOVOLOG FLEXPEN subcutaneous, VICTOZA 2-PAK subcutaneous, HUMALOG subcutaneous, STARLIX oral, FORTAMET oral, GLUCOVANCE oral, GLUCOPHAGE XR oral, NOVOLOG Mix 70-30 FLEXPEN subcutaneous, GLYBURIDE-METFORMIN oral, acarbose oral, SYMLINPEN 60 subcutaneous, GLUCOTROI XL oral, NOVOLIN R inj, GLUCOTROL oral, DUETACT oral, sitagliptin oral, SYMLINPEN 120 subcutaneous, HUMALOG KWIKPEN subcutaneous, JANUMET XR oral, GLIPIZIDE-METFORMIN oral, CYCLOSET oral, HUMALOG MIX 75-25 subcutaneous, nateglinide oral, HUMALOG Mix 75-25 KWIKPEN subcutaneous, HUMULIN 70/30 subcutaneous, PRECOSE oral, APIDRA subcutaneous, Humulin R inj, Jentadueto oral, Victoza 3-Pak subcutaneous, Novolin 70/30 subcutaneous, NOVOLIN N subcutaneous, insulin detemir subcutaneous, glyburide micronized oral, GLYNASE oral, HUMULIN N subcutaneous, insulin glargine subcutaneous, RIOMET oral, pioglitazone-metformin oral, APIDRA SOLOSTAR subcutaneous, insulin lispro subcutaneous, GLYSET oral, HUMULIN 70/30 Pen subcutaneous, colesevelam oral, sitagliptin-metformin oral, DIABETA oral, insulin regular human inj, HUMULIN N Pen subcutaneous, exenatide subcutaneous, HUMALOG Mix 50-50 KWIKPEN subcutaneous, liraglutide subcutaneous, KAZANO oral, repaglinide oral, chlorpropamide oral, insulin aspart subcutaneous, NOVOLOG Mix 70-30 subcutaneous, HUMALOG Mix 50-50 subcutaneous, saxagliptin oral, ACTOPLUS MetXR oral, miglitol oral, NPH insulin human recomb subcutaneous, insulin NPH and regular human subcutaneous, tolazamide oral, mifepristone oral, insulin aspart protam-insulin aspart subcutaneous, repaglinide-metformin oral, saxagliptin-metformin oral, linagliptin-metformin oral, NESINA oral, OSENI oral, tolbutamide oral, insulin lispro protamine and lispro subcutaneous, pramlintide subcutaneous, insulin glulisine subcutaneous, pioglitazone-glimepiride oral, PRANDIMET oral, NOVOLOG PenFill subcutaneous, linagliptin oral, exenatide microspheres subcutaneous, KORLYM oral, alogliptin oral, alogliptin-pioglitazone oral, alogliptin-metformin oral, canagliflozin oral, Lispro (HUMALOG); Aspart (NOVOLOG); Glulisine (APIDRA); Regular (NOVOLIN R or HUMULIN R); NPH (NOVOLIN N or HUMULIN N); Glargine (LANTUS); Detemir (LEVEMIR); HUMULIN or NOVOLIN 70/30; and NOVOLOG Mix 70/30 HUMALOG Mix 75/25 or 50/50.

In some embodiments, the present invention relates to combination therapy with a blood transfusion. For instance, the present compositions may supplement a blood transfusion. In some embodiments, the present invention relates to combination therapy with iron supplements.

In some embodiments, the present invention relates to combination therapy with one or more EPO-based agents. For example, the present compositions may be used as an adjuvant to other EPO-based agents. In some embodiments, the present compositions are used as a maintenance therapy to other EPO-based agents. Other EPO-based agents include the following: epoetin alfa, including without limitation, DARBEPOETIN (ARANESP), EPOCEPT (LUPIN PHARMA), NANOKINE (NANOGEN PHARMACEUTICAL), EPOFIT (INTAS PHARMA), EPOGEN (AMGEN), EPOGIN, EPREX, (JANSSEN-CILAG), BINOCRIT (SANDOZ), PROCRIT; epoetin beta, including without limitation, NEORECORMON (HOFFMANN-LA ROCHE), RECORMON, Methoxy polyethylene glycol-epoetin beta (MIRCERA, ROCHE); epoetin delta, including without limitation, DYNEPO (erythropoiesis stimulating protein, SHIRE PLC); epoetin omega, including without limitation, EPOMAX; epoetin zeta, including without limitation, SILAPO (STADA) and RETACRIT (HOSPIRA) and other EPOs, including without limitation, EPOCEPT (LUPIN PHARMACEUTICALS), EPOTRUST (PANACEA BIOTEC LTD), ERYPRO SAFE (BIOCON LTD.), REPOITIN (SERUM INSTITUTE OF INDIA LIMITED), VINTOR (EMCURE PHARMACEUTICALS), EPOFIT (INTAS PHARMA), ERYKINE (INTAS BIOPHARMACEUTICA), WEPOX (WOCKHARDT BIOTECH), ESPOGEN (LG LIFE SCIENCES), RELIPOIETIN (RELIANCE LIFE SCIENCES), SHANPOIETIN (SHANTHA BIOTECHNICS LTD), ZYROP (CADILA HEALTHCARE LTD.), EPIAO (RHUEPO) (SHENYANG SUNSHINE PHARMACEUTICAL CO. LTD), CINNAPOIETIN (CINNAGEN).

In some embodiments, the present invention relates to combination therapy with one or more immune-modulating agents, for example, without limitation, agents that modulate immune checkpoint. In various embodiments, the immune-modulating agent targets one or more of PD-1, PD-L1, and PD-L2. In various embodiments, the immune-modulating agent is PD-1 inhibitor. In various embodiments, the immune-modulating agent is an antibody specific for one or more of PD-1, PD-L1, and PD-L2. For instance, in some embodiments, the immune-modulating agent is an antibody such as, by way of non-limitation, nivolumab, (ONO-4538/BMS-936558, MDX1106, OPDIVO, BRISTOL MYERS SQUIBB), pembrolizumab (KEYTRUDA, MERCK), pidilizumab (CT-011, CURE TECH), MK-3475 (MERCK), BMS 936559 (BRISTOL MYERS SQUIBB), MPDL3280A (ROCHE). In some embodiments, the immune-modulating agent targets one or more of CD137 or CD137L. In various embodiments, the immune-modulating agent is an antibody specific for one or more of CD137 or CD137L. For instance, in some embodiments, the immune-modulating agent is an antibody such as, by way of non-limitation, urelumab (also known as BMS-663513 and anti-4-1BB antibody). In some embodiments, the present chimeric protein or chimeric protein complex is combined with urelumab (optionally with one or more of nivolumab, lirilumab, and urelumab) for the treatment of solid tumors and/or B-cell non-Hodgkins lymphoma and/or head and neck cancer and/or multiple myeloma. In some embodiments, the immune-modulating agent is an agent that targets one or more of CTLA-4, AP2M1, CD80, CD86, SHP-2, and PPP2R5A. In various embodiments, the immune-modulating agent is an antibody specific for one or more of CTLA-4, AP2M1, CD80, CD86, SHP-2, and PPP2R5A. For instance, in some embodiments, the immune-modulating agent is an antibody such as, by way of non-limitation, ipilimumab (MDX-010, MDX-101, Yervoy, BMS) and/or tremelimumab (Pfizer). In some embodiments, the present chimeric protein or chimeric protein complex is combined with ipilimumab (optionally with bavituximab) for the treatment of one or more of melanoma, prostate cancer, and lung cancer. In various embodiments, the immune-modulating agent targets CD20. In various embodiments, the immune-modulating agent is an antibody specific CD20. For instance, in some embodiments, the immune-modulating agent is an antibody such as, by way of non-limitation, Ofatumumab (GENMAB), obinutuzumab (GAZYVA), AME-133v (APPLIED MOLECULAR EVOLUTION), Ocrelizumab (GENENTECH), TRU-015 (TRUBION/EMERGENT), veltuzumab (IMMU-106).

In some embodiments, the present chimeric protein or chimeric protein complex acts synergistically when used in combination with Chimeric Antigen Receptor (CAR) T-cell therapy. In an illustrative embodiment, the chimeric protein or chimeric protein complex acts synergistically when used in combination with CAR T-cell therapy in treating tumor or cancer. In an embodiment, the chimeric protein or chimeric protein complex acts synergistically when used in combination with CAR T-cell therapy in treating blood-based tumors. In an embodiment, the chimeric protein or chimeric protein complex acts synergistically when used in combination with CAR T-cell therapy in treating solid tumors. For example, use of the chimeric protein or chimeric protein complex and CAR T-cells may act synergistically to reduce or eliminate the tumor or cancer, or slow the growth and/or progression and/or metastasis of the tumor or cancer. In various embodiments, the chimeric protein or chimeric protein complex of the invention induces CAR T-cell division. In various embodiments, the chimeric protein or chimeric protein complex of the invention induces CAR T-cell proliferation. In various embodiments, the chimeric protein or chimeric protein complex of the invention prevents anergy of the CAR T cells.

In various embodiments, the CAR T-cell therapy comprises CAR T cells that target antigens (e.g., tumor antigens) such as, but not limited to, carbonic anhydrase IX (CAIX), 5T4, CD19, CD20, CD22, CD27, CD30, CD33, CD38, CD47, CD70, CS1, CD138, Lewis-Y, L1-CAM, MUC16, ROR-1, IL13Rα2, gp100, prostate stem cell antigen (PSCA), prostate-specific membrane antigen (PSMA), B-cell maturation antigen (BCMA), human papillomavirus type 16 E6 (HPV-16 E6), CD171, folate receptor alpha (FR-α), GD2, human epidermal growth factor receptor 2 (HER2), mesothelin, EGFRvIII, fibroblast activation protein (FAP), carcinoembryonic antigen (CEA), and vascular endothelial growth factor receptor 2 (VEGF-R2), as well as other tumor antigens well known in the art. Additional illustrative tumor antigens include, but are not limited to MART-1/Melan-A, gp100, Dipeptidyl peptidase IV (DP-PIV), adenosine deaminase-binding protein (ADAbp), cyclophilin b, Colorectal associated antigen (CRC)-0017-1A/GA733, Carcinoembryonic Antigen (CEA) and its immunogenic epitopes CAP-1 and CAP-2, etv6, aml1, Prostate Specific Antigen (PSA) and its immunogenic epitopes PSA-1, PSA-2, and PSA-3, T-cell receptor/CD3-zeta chain, MAGE-family of tumor antigens (e.g., MAGE-A1, MAGE-A2, MAGE-A3, MAGE-A4, MAGE-A5, MAGE-A6, MAGE-A7, MAGE-A8, MAGE-A9, MAGE-A10, MAGE-A11, MAGE-A12, MAGE-Xp2 (MAGE-B2), MAGE-Xp3 (MAGE-B3), MAGE-Xp4 (MAGE-B4), MAGE-C1, MAGE-C2, MAGE-C3, MAGE-C4, MAGE-C5), GAGE-family of tumor antigens (e.g., GAGE-1, GAGE-2, GAGE-3, GAGE-4, GAGE-5, GAGE-6, GAGE-7, GAGE-8, GAGE-9), BAGE, RAGE, LAGE-1, NAG, GnT-V, MUM-1, CDK4, tyrosinase, p53, MUC family, HER2/neu, p21ras, RCAS1, α-fetoprotein, E-cadherin, α-catenin, β-catenin and γ-catenin, p120ctn, gp100 Pmel117, PRAME, NY-ESO-1, cdc27, adenomatous polyposis coli protein (APC), fodrin, Connexin 37, Ig-idiotype, p15, gp75, GM2 and GD2 gangliosides, viral products such as human papilloma virus proteins, Smad family of tumor antigens, Imp-1, NA, EBV-encoded nuclear antigen (EBNA)-1, brain glycogen phosphorylase, SSX-1, SSX-2 (HOM-MEL-40), SSX-1, SSX-4, SSX-5, SCP-1 CT-7, c-erbB-2, CD19, CD37, CD56, CD70, CD74, CD138, AGS16, MUC1, GPNMB, Ep-CAM, PD-L1, and PD-L2.

Illustrative CAR T-cell therapy include, but are not limited to, JCAR014 (Juno Therapeutics), JCAR015 (Juno Therapeutics), JCAR017 (Juno Therapeutics), JCAR018 (Juno Therapeutics), JCAR020 (Juno Therapeutics), JCAR023 (Juno Therapeutics), JCAR024 (Juno Therapeutics), CTL019 (Novartis), KTE-C19 (Kite Pharma), BPX-401 (Bellicum Pharmaceuticals), BPX-501 (Bellicum Pharmaceuticals), BPX-601 (Bellicum Pharmaceuticals), bb2121 (Bluebird Bio), CD-19 Sleeping Beauty cells (Ziopharm Oncology), UCART19 (Cellectis), UCART123 (Cellectis), UCART38 (Cellectis), UCARTCS1 (Cellectis), OXB-302 (Oxford BioMedica, MB-101 (Mustang Bio) and CAR T-cells developed by Innovative Cellular Therapeutics.

In some embodiments, the present invention relates to combination therapy with one or more chimeric agents described in WO 2013/10779, WO 2015/007536, WO 2015/007520, WO 2015/007542, and WO 2015/007903, the entire contents of which are hereby incorporated by reference in their entireties.

In some embodiments, the chimeric protein or chimeric protein complex described herein, include derivatives that are modified, i.e., by the covalent attachment of any type of molecule to the composition such that covalent attachment does not prevent the activity of the composition. For example, but not by way of limitation, derivatives include composition that have been modified by, inter alia, glycosylation, lipidation, acetylation, pegylation, phosphorylation, amidation, derivatization by known protecting/blocking groups, proteolytic cleavage, linkage to a cellular ligand or other protein, etc. Any of numerous chemical modifications can be carried out by known techniques, including, but not limited to specific chemical cleavage, acetylation, formylation, metabolic synthesis of tunicamycin, etc.

In still other embodiments, the chimeric protein or chimeric protein complex described herein further comprise a cytotoxic agent, comprising, in illustrative embodiments, a toxin, a chemotherapeutic agent, a radioisotope, and an agent that causes apoptosis or cell death. Such agents may be conjugated to a composition described herein.

The chimeric protein or chimeric protein complex described herein may thus be modified post-translationally to add effector moieties such as chemical linkers, detectable moieties such as for example fluorescent dyes, enzymes, substrates, bioluminescent materials, radioactive materials, and chemiluminescent moieties, or functional moieties such as for example streptavidin, avidin, biotin, a cytotoxin, a cytotoxic agent, and radioactive materials.

Illustrative cytotoxic agents include, but are not limited to, methotrexate, aminopterin, 6-mercaptopurine, 6-thioguanine, cytarabine, 5-fluorouracil decarbazine; alkylating agents such as mechlorethamine, thioepa chlorambucil, melphalan, carmustine (BSNU), mitomycin C, lomustine (CCNU), 1-methylnitrosourea, cyclothosphamide, mechlorethamine, busulfan, dibromomannitol, streptozotocin, mitomycin C, cis-dichlorodiamine platinum (II) (DDP) cisplatin and carboplatin (paraplatin); anthracyclines include daunorubicin (formerly daunomycin), doxorubicin (adriamycin), detorubicin, carminomycin, idarubicin, epirubicin, mitoxantrone and bisantrene; antibiotics include dactinomycin (actinomycin D), bleomycin, calicheamicin, mithramycin, and anthramycin (AMC); and antimytotic agents such as the vinca alkaloids, vincristine and vinblastine. Other cytotoxic agents include paclitaxel (taxol), ricin, pseudomonas exotoxin, gemcitabine, cytochalasin B, gramicidin D, ethidium bromide, emetine, etoposide, tenoposide, colchicin, dihydroxy anthracin dione, 1-dehydrotestosterone, glucocorticoids, procaine, tetracaine, lidocaine, propranolol, puromycin, procarbazine, hydroxyurea, asparaginase, corticosteroids, mytotane (O,P'-(DDD)), interferons, and mixtures of these cytotoxic agents.

Further cytotoxic agents include, but are not limited to, chemotherapeutic agents such as carboplatin, cisplatin, paclitaxel, gemcitabine, calicheamicin, doxorubicin, 5-fluorouracil, mitomycin C, actinomycin D, cyclophosphamide, vincristine, bleomycin, VEGF antagonists, EGFR antagonists, platins, taxols, irinotecan, 5-fluorouracil, gemcytabine, leucovorine, steroids, cyclophosphamide, melphalan, vinca alkaloids (e.g., vinblastine, vincristine, vindesine and vinorelbine), mustines, tyrosine kinase inhibitors, radiotherapy, sex hormone antagonists, selective androgen receptor modulators, selective estrogen receptor modulators, PDGF antagonists, TNF antagonists, IL-1 antagonists, interleukins (e.g. IL-12 or IL-2), IL-12R antagonists, Toxin conjugated monoclonal antibodies, tumor antigen specific monoclonal antibodies, Erbitux, Avastin, Pertuzumab, anti-CD20 antibodies, Rituxan, ocrelizumab, ofatumumab, DXL625, HERCEPTIN®, or any combination thereof. Toxic enzymes from plants and bacteria such as ricin, diphtheria toxin and Pseudomonas toxin may be conjugated to the therapeutic agents (e.g. antibodies) to generate cell-type-specific-killing reagents (Youle, et al., Proc. Nat'l Acad. Sci. USA 77:5483 (1980); Gilliland, et al., Proc. Nat'l Acad. Sci. USA 77:4539 (1980); Krolick, et al., Proc. Nat'l Acad. Sci. USA 77:5419 (1980)).

Other cytotoxic agents include cytotoxic ribonucleases as described by Goldenberg in U.S. Pat. No. 6,653,104. Embodiments of the invention also relate to radioimmunoconjugates where a radionuclide that emits alpha or beta particles is stably coupled to the chimeric protein, with or without the use of a complex-forming agent. Such radionuclides include beta-emitters such as Phosphorus-32, Scandium-47, Copper-67, Gallium-67, Yttrium-88, Yttrium-90, Iodine-125, Iodine-131, Samarium-153, Lutetium-177, Rhenium-186 or Rhenium-188, and alpha-emitters such as Astatine-211, Lead-212, Bismuth-212, Bismuth-213 or Actinium-225.

Illustrative detectable moieties further include, but are not limited to, horseradish peroxidase, acetylcholinesterase, alkaline phosphatase, beta-galactosidase and luciferase. Further illustrative fluorescent materials include, but are not limited to, rhodamine, fluorescein, fluorescein isothiocyanate, umbelliferone, dichlorotriazinylamine, phycoerythrin and dansyl chloride. Further illustrative chemiluminescent moieties include, but are not limited to, luminol. Further illustrative bioluminescent materials include, but are not limited to, luciferin and aequorin. Further illustrative radioactive materials include, but are not limited to, Iodine-125, Carbon-14, Sulfur-35, Tritium and Phosphorus-32.

Methods of Treatment

Methods and compositions described herein have application to treating various diseases and disorders, including, but not limited to cancer, infections, immune disorders, anemia, autoimmune diseases, cardiovascular diseases, wound healing, ischemia-related diseases, neurodegenerative diseases, metabolic diseases and many other diseases and disorders.

Further, any of the present agents may be for use in the treating, or the manufacture of a medicament for treating, various diseases and disorders, including, but not limited to cancer, infections, immune disorders, inflammatory diseases or conditions, and autoimmune diseases.

In some embodiments, the present invention relates to the treatment of, or a patient having one or more of chronic granulomatous disease, osteopetrosis, idiopathic pulmonary fibrosis, Friedreich's ataxia, atopic dermatitis, Chagas disease, cancer, heart failure, autoimmune disease, sickle cell disease, thalassemia, blood loss, transfusion reaction, diabetes, vitamin B12 deficiency, collagen vascular disease, Shwachman syndrome, thrombocytopenic purpura, Celiac disease, endocrine deficiency state such as hypothyroidism or Addison's disease, autoimmune disease such as Crohn's Disease, systemic lupus erythematosis, rheumatoid arthritis or juvenile rheumatoid arthritis, ulcerative colitis immune disorders such as eosinophilic fasciitis, hypoimmunoglobulinemia, or thymoma/thymic carcinoma, graft versus host disease, preleukemia, Nonhematologic syndrome (e.g., Down's, Dubowwitz, Seckel), Felty syndrome, hemolytic uremic syndrome, myelodysplasic syndrome, nocturnal paroxysmal hemoglobinuria, osteomyelofibrosis, pancytopenia, pure red-cell aplasia, Schoenlein-Henoch purpura, malaria, protein starvation, menorrhagia, systemic sclerosis, liver cirrhosis, hypometabolic states, and congestive heart failure.

In some embodiments, the present invention relates to the treatment of, or a patient having one or more of chronic granulomatous disease, osteopetrosis, idiopathic pulmonary fibrosis, Friedreich's ataxia, atopic dermatitis, Chagas disease, mycobacterial infections, cancer, scleroderma, hepatitis, hepatitis C, septic shock, and rheumatoid arthritis.

In some embodiments, the present invention relates to the treatment of, or a patient having cancer. As used herein, cancer refers to any uncontrolled growth of cells that may interfere with the normal functioning of the bodily organs and systems, and includes both primary and metastatic tumors. Primary tumors or cancers that migrate from their original location and seed vital organs can eventually lead to the death of the subject through the functional deterioration of the affected organs. A metastasis is a cancer cell or group of cancer cells, distinct from the primary tumor location, resulting from the dissemination of cancer cells from the primary tumor to other parts of the body. Metastases may eventually result in death of a subject. For example, cancers can include benign and malignant cancers, polyps, hyperplasia, as well as dormant tumors or micrometastases.

Illustrative cancers that may be treated include, but are not limited to, carcinomas, e.g. various subtypes, including, for example, adenocarcinoma, basal cell carcinoma, squamous cell carcinoma, and transitional cell carcinoma), sarcomas (including, for example, bone and soft tissue), leukemias (including, for example, acute myeloid, acute lymphoblastic, chronic myeloid, chronic lymphocytic, and hairy cell), lymphomas and myelomas (including, for example, Hodgkin and non-Hodgkin lymphomas, light chain, non-secretory, MGUS, and plasmacytomas), and central nervous system cancers (including, for example, brain (e.g. gliomas (e.g. astrocytoma, oligodendroglioma, and ependymoma), meningioma, pituitary adenoma, and neuromas, and spinal cord tumors (e.g. meningiomas and neurofibroma).

Illustrative cancers that may be treated include, but are not limited to, basal cell carcinoma, biliary tract cancer; bladder cancer; bone cancer; brain and central nervous system cancer; breast cancer; cancer of the peritoneum; cervical cancer; choriocarcinoma; colon and rectum cancer; connective tissue cancer; cancer of the digestive system; endometrial cancer; esophageal cancer; eye cancer; cancer of the head and neck; gastric cancer (including gastrointestinal cancer); glioblastoma; hepatic carcinoma; hepatoma; intraepithelial neoplasm; kidney or renal cancer; larynx cancer; leukemia; liver cancer; lung cancer (e.g., small-cell lung cancer, non-small cell lung cancer, adenocarcinoma of the lung, and squamous carcinoma of the lung); melanoma; myeloma; neuroblastoma; oral cavity cancer (lip, tongue, mouth, and pharynx); ovarian cancer; pancreatic cancer; prostate cancer; retinoblastoma; rhabdomyosarcoma; rectal cancer; cancer of the respiratory system; salivary gland carcinoma; sarcoma; skin cancer; squamous cell cancer; stomach cancer; testicular cancer; thyroid cancer; uterine or endometrial cancer; cancer of the urinary system; vulval cancer; lymphoma including Hodgkin's and non-Hodgkin's lymphoma, as well as B-cell lymphoma (including low grade/follicular non-Hodgkin's lymphoma (NHL); small lymphocytic (SL) NHL; intermediate grade/follicular NHL; intermediate grade diffuse NHL; high grade immunoblastic NHL; high grade lymphoblastic NHL; high grade small non-cleaved cell NHL; bulky disease NHL; mantle cell lymphoma; AIDS-related lymphoma; and Waldenstrom's Macroglobulinemia; chronic lymphocytic leukemia (CLL); acute lymphoblastic leukemia (ALL); Hairy cell leukemia;

chronic myeloblastic leukemia; as well as other carcinomas and sarcomas; and post-transplant lymphoproliferative disorder (PTLD), as well as abnormal vascular proliferation associated with phakomatoses, edema (e.g. that associated with brain tumors), and Meigs' syndrome.

In various embodiments, the present invention relates to the treatment of Myc-driven cancers, i.e., cancer cells that overexpress Myc. In some embodiments, the cancer cells overexpress any one of c-Myc, N-Myc, and/or L-Myc. In some embodiments, methods of the invention renders the cancer cells susceptible to treatment with any one of the anti-cancer therapeutic agents described herein. In some embodiments, methods of the invention reduce the transcriptional activities of the cancer cells.

In some embodiments, the present invention relates to the treatment of, or a patient having a microbial infection and/or chronic infection. Illustrative infections include, but are not limited to, Chagas disease, HIV/AIDS, tuberculosis, osteomyelitis, hepatitis B, hepatitis C, Epstein-Barr virus or parvovirus, T cell leukemia virus, bacterial overgrowth syndrome, fungal or parasitic infections.

In various embodiments, the present compositions are used to treat or prevent one or more inflammatory diseases or conditions, such as inflammation, acute inflammation, chronic inflammation, respiratory disease, atherosclerosis, restenosis, asthma, allergic rhinitis, atopic dermatitis, septic shock, rheumatoid arthritis, inflammatory bowel disease, inflammatory pelvic disease, pain, ocular inflammatory disease, celiac disease, Leigh Syndrome, Glycerol Kinase Deficiency, Familial eosinophilia (FE), autosomal recessive spastic ataxia, laryngeal inflammatory disease; Tuberculosis, Chronic cholecystitis, Bronchiectasis, Silicosis and other pneumoconioses.

In various embodiments, the present compositions are used to treat or prevent one or more autoimmune diseases or conditions, such as multiple sclerosis, diabetes mellitus, lupus, celiac disease, Crohn's disease, ulcerative colitis, Guillain-Barre syndrome, scleroderms, Goodpasture's syndrome, Wegener's granulomatosis, autoimmune epilepsy, Rasmussen's encephalitis, Primary biliary sclerosis, Sclerosing cholangitis, Autoimmune hepatitis, Addison's disease, Hashimoto's thyroiditis, Fibromyalgia, Menier's syndrome; transplantation rejection (e.g., prevention of allograft rejection) pernicious anemia, rheumatoid arthritis, systemic lupus erythematosus, dermatomyositis, Sjogren's syndrome, lupus erythematosus, multiple sclerosis, myasthenia gravis, Reiter's syndrome, Grave's disease, and other autoimmune diseases.

In various embodiments, the present compositions are used to treat, control or prevent cardiovascular disease, such as a disease or condition affecting the heart and vasculature, including but not limited to, coronary heart disease (CHD), cerebrovascular disease (CVD), aortic stenosis, peripheral vascular disease, atherosclerosis, arteriosclerosis, myocardial infarction (heart attack), cerebrovascular diseases (stroke), transient ischaemic attacks (TIA), angina (stable and unstable), atrial fibrillation, arrhythmia, valvular disease, and/or congestive heart failure.

In various embodiments, the present compositions are used to treat or prevent one or more metabolic-related disorders. In various embodiments, the present invention is useful for the treatment, controlling or prevention of diabetes, including Type 1 and Type 2 diabetes and diabetes associated with obesity. The compositions and methods of the present invention are useful for the treatment or prevention of diabetes-related disorders, including without limitation diabetic nephropathy, hyperglycemia, impaired glucose tolerance, insulin resistance, obesity, lipid disorders, dyslipidemia, hyperlipidemia, hypertriglyceridemia, hypercholesterolemia, low HDL levels, high LDL levels, atherosclerosis and its sequelae, vascular restenosis, irritable bowel syndrome, inflamatory bowel disease, including Crohn's disease and ulcerative colitis, other inflammatory conditions, pancreatitis, abdominal obesity, neurodegenerative disease, retinopathy, neoplastic conditions, adipose cell tumors, adipose cell carcinomas, such as liposarcoma, prostate cancer and other cancers, including gastric, breast, bladder and colon cancers, angiogenesis, Alzheimer's disease, psoriasis, high blood pressure, Metabolic Syndrome (e.g. a person has three or more of the following disorders: abdominal obesity, hypertriglyceridemia, low HDL cholesterol, high blood pressure, and high fasting plasma glucose), ovarian hyperandrogenism (polycystic ovary syndrome), and other disorders where insulin resistance is a component, such as sleep apnea. The compositions and methods of the present invention are useful for the treatment, control, or prevention of obesity, including genetic or environmental, and obesity-related disorders. The obesity-related disorders herein are associated with, caused by, or result from obesity. Examples of obesity-related disorders include obesity, diabetes, overeating, binge eating, and bulimia, hypertension, elevated plasma insulin concentrations and insulin resistance, dyslipidemia, hyperlipidemia, endometrial, breast, prostate, kidney and colon cancer, osteoarthritis, obstructive sleep apnea, gallstones, heart disease, abnormal heart rhythms and arrythmias, myocardial infarction, congestive heart failure, coronary heart disease, sudden death, stroke, polycystic ovary disease, craniopharyngioma, Prader-Willi Syndrome, Frohlich's syndrome, GH-deficient subjects, normal variant short stature, Turner's syndrome, and other pathological conditions showing reduced metabolic activity or a decrease in resting energy expenditure as a percentage of total fat-free mass, e.g, children with acute lymphoblastic leukemia. Further examples of obesity-related disorders are Metabolic Syndrome, insulin resistance syndrome, reproductive hormone abnormalities, sexual and reproductive dysfunction, such as impaired fertility, infertility, hypogonadism in males and hirsutism in females, fetal defects associated with maternal obesity, gastrointestinal motility disorders, such as obesity-related gastro-esophageal reflux, respiratory disorders, such as obesity-hypoventilation syndrome (Pickwickian syndrome), breathlessness, cardiovascular disorders, inflammation, such as systemic inflammation of the vasculature, arteriosclerosis, hypercholesterolemia, lower back pain, gallbladder disease, hyperuricemia, gout, and kidney cancer, and increased anesthetic risk. The compositions and methods of the present invention are also useful to treat Alzheimer's disease.

In various embodiments, the present compositions are used to treat or prevent one or more respiratory diseases, such as idiopathic pulmonary fibrosis (IPF), asthma, chronic obstructive pulmonary disease (COPD), bronchiectasis, allergic rhinitis, sinusitis, pulmonary vasoconstriction, inflammation, allergies, impeded respiration, respiratory distress syndrome, cystic fibrosis, pulmonary hypertension, pulmonary vasoconstriction, emphysema, Hantavirus pulmonary syndrome (HPS), Loeffler's syndrome, Goodpasture's syndrome, Pleurisy, pneumonitis, pulmonary edema, pulmonary fibrosis, Sarcoidosis, complications associated with respiratory syncitial virus infection, and other respiratory diseases.

In some embodiments, the present invention is used to treat or prevent one or more neurodegenerative disease. Illustrative neurodegenerative diseases include, but are not limited to, Friedreich's ataxia, multiple sclerosis (including without limitation, benign multiple sclerosis; relapsing-remitting multiple sclerosis (RRMS); secondary progressive multiple sclerosis (SPMS); progressive relapsing multiple sclerosis (PRMS); and primary progressive multiple sclerosis (PPMS)), Alzheimer's. disease (including, without limitation, Early-onset Alzheimer's, Late-onset Alzheimer's, and Familial Alzheimer's disease (FAD), Parkinson's disease and parkinsonism (including, without limitation, Idiopathic Parkinson's disease, Vascular parkinsonism, Drug-induced parkinsonism, Dementia with Lewy bodies, Inherited Parkinson's, Juvenile Parkinson's), Huntington's disease, Amyotrophic lateral sclerosis (ALS, including, without limitation, Sporadic ALS, Familial ALS, Western Pacific ALS, Juvenile ALS, Hiramaya Disease).

In various embodiments, the present chimeric proteins or chimeric protein complexes find use in treating wounds, e.g., a non-healing wound, an ulcer, a burn, or frostbite, a chronic or acute wound, open or closed wound, internal or external wound (illustrative external wounds are penetrating and non-penetrating wound. In various embodiments, the present chimeric proteins or chimeric protein complexes find use in treating ischemia, by way of non-limiting example, ischemia associated with acute coronary syndrome, acute lung injury (ALI), acute myocardial infarction (AMI), acute respiratory distress syndrome (ARDS), arterial occlusive disease, arteriosclerosis, articular cartilage defect, aseptic systemic inflammation, atherosclerotic cardiovascular disease, autoimmune disease, bone fracture, bone fracture, brain edema, brain hypoperfusion, Buerger's disease, burns, cancer, cardiovascular disease, cartilage damage, cerebral infarct, cerebral ischemia, cerebral stroke, cerebrovascular disease, chemotherapy-induced neuropathy, chronic infection, chronic mesenteric ischemia, claudication, congestive heart failure, connective tissue damage, contusion, coronary artery disease (CAD), critical limb ischemia (CLI), Crohn's disease, deep vein thrombosis, deep wound, delayed ulcer healing, delayed wound-healing, diabetes (type I and type II), diabetic neuropathy, diabetes induced ischemia, disseminated intravascular coagulation (DIC), embolic brain ischemia, frostbite, graft-versus-host disease, hereditary hemorrhagic telengiectasiaischemic vascular disease, hyperoxic injury, hypoxia, inflammation, inflammatory bowel disease, inflammatory disease, injured tendons, intermittent claudication, intestinal ischemia, ischemia, ischemic brain disease, ischemic heart disease, ischemic peripheral vascular disease, ischemic placenta, ischemic renal disease, ischemic vascular disease, ischemic-reperfusion injury, laceration, left main coronary artery disease, limb ischemia, lower extremity ischemia, myocardial infarction, myocardial ischemia, organ ischemia, osteoarthritis, osteoporosis, osteosarcoma, Parkinson's disease, peripheral arterial disease (PAD), peripheral artery disease, peripheral ischemia, peripheral neuropathy, peripheral vascular disease, pre-cancer, pulmonary edema, pulmonary embolism, remodeling disorder, renal ischemia, retinal ischemia, retinopathy, sepsis, skin ulcers, solid organ transplantation, spinal cord injury, stroke, subchondral-bone cyst, thrombosis, thrombotic brain ischemia, tissue ischemia, transient ischemic attack (TIA), traumatic brain injury, ulcerative colitis, vascular disease of the kidney, vascular inflammatory conditions, von Hippel-Lindau syndrome, or wounds to tissues or organs In various embodiments, the present invention relates to the treatment of one or more of anemia, including anemia resulting from chronic kidney disease (e.g. from dialysis) and/or an anti-cancer agent (e.g. chemotherapy and/or HIV treatment (e.g. Zidovudine (INN) or azidothymidine (AZT)), inflammatory bowel disease (e.g. Crohn's disease and ulcer colitis), anemia linked to inflammatory conditions (e.g. arthritis, lupus, IBD), anemia linked to diabetes, schizophrenia, cerebral malaria, as aplastic anemia, and myelodysplasia from the treatment of cancer (e.g. chemotherapy and/or radiation), and various myelodysplastic syndrome diseases (e.g. sickle cell anemia, hemoglobin SC disease, hemoglobin C disease, alpha- and beta-thalassemias, neonatal anemia after premature birth, and comparable conditions).

In some embodiments, the present invention relates to the treatment of, or a patient having anemia, i.e. a condition in which the number of red blood cells and/or the amount of hemoglobin found in the red blood cells is below normal. In various embodiments, the anemia may be acute or chronic. For example, the present anemias include but are not limited to iron deficiency anemia, renal anemia, anemia of chronic diseases/inflammation, pernicious anemia such as macrocytic achylic anemia, juvenile pernicious anemia and congenital pernicious anemia, cancer-related anemia, anti-cancer-related anemia (e.g. chemotherapy-related anemia, radiotherapy-related anemia), pure red cell aplasia, refractory anemia with excess of blasts, aplastic anemia, X-lined sideroblastic anemia, hemolytic anemia, sickle cell anemia, anemia caused by impaired production of ESA, myelodysplasia syndromes, hypochromic anemia, microcytic anemia, sideroblastic anemia, autoimmune hemolytic anemia, Cooley's anemia, Mediterranean anemia, Diamond Blackfan anemia, Fanconi's anemia and drug-induced immune hemolytic anemia. Anemia may cause serious symptoms, including hypoxia, chronic fatigue, lack of concentration, pale skin, low blood pressure, dizziness and heart failure.

In some embodiments, the present invention relates to the treatment of anemia resulting from chronic renal failure. In some embodiments, the present invention relates to the treatment of anemia resulting from the use of one or more renal replacement therapies, inclusive of dialysis, hemodialysis, peritoneal dialysis, hemofiltration, hemodiafiltration, and renal transplantation.

In some embodiments, the present invention relates to the treatment of anemia in patients with chronic kidney disease who are not on dialysis. For instance, the present invention relates to patients in stage 1 CKD, or stage 2 CKD, or stage 3 CKD, or stage 4 CKD, or stage 5 CKD. In some embodiments, the present patient is stage 4 CKD or stage 5 CKD. In some embodiments, the present patient has undergone a kidney transplant. In some embodiments, the present invention relates to the treatment of anemia is a patient having an acute kidney injury (AKI).

In some embodiments, the anemia is induced by chemotherapy. For instance, the chemotherapy may be any myelosuppressive chemotherapy. In some embodiment, the chemotherapy is one or more of Revlimid, Thalomid, dexamethasone, Adriamycin and Doxil. In some embodiments, the chemotherapy is one or more platinum-based drugs including cisplatin (e.g. PLATINOL) and carboplatin (e.g. PARAPLATIN). In some embodiments, the chemotherapy is any one of the chemotherapeutic agents described herein. In some embodiments, the chemotherapy is any agent described in Groopman et al. J Natl Cancer Inst (1999) 91 (19): 1616-1634, the contents of which are hereby incorporated by reference in their entireties. In some embodiments, the present compositions and methods are used in the treatment of chemotherapy-related anemia in later stage cancer patients (e.g. a stage IV, or stage III, or stage II cancer). In some embodiments, the present compositions and methods are used in the treatment of chemotherapy-related anemia in cancer patients receiving dose-dense chemotherapy or other aggressive chemotherapy regimens.

In some embodiments, the present invention relates to the treatment of anemia in a patient having one or more blood-based cancers, such as leukemia, lymphoma, and multiple myeloma. Such cancers may affect the bone marrow directly. Further, the present invention relates to metastatic cancer that has spread to the bone or bone marrow. In some embodiments, the present invention relates to the treatment of anemia in a patient undergoing radiation therapy. Such radiation therapy may damage the bone marrow, lowering its ability to make red blood cells. In further embodiments, the present invention relates to the treatment of anemia in a patient having a reduction or deficiency of one or more of iron, vitamin B12, and folic acid. In further embodiments, the present invention relates to the treatment of anemia in a patient having excessive bleeding including without limitation, after surgery or from a tumor that is causing internal bleeding. In further embodiments, the present invention relates to the treatment of anemia in a patient having anemia of chronic disease.

In some embodiments, the present methods and compositions stimulate red blood cell production. In some embodiments, the present methods and compositions stimulate division and differentiation of committed erythroid progenitors in the bone marrow.

Certain embodiments of the present invention are particularly useful for treating chemotherapy-induced anemia in cancer patients. In some embodiments, the present methods and compositions allows for continued administration of the chimeric protein or chimeric protein complex after a cancer patient's chemotherapy is finished. In some embodiments, the present methods and compositions allows for treatment of a cancer patient without dose reduction relative to a non-cancer patient. In some embodiments, the present methods and compositions allows for treatment of a cancer patient receiving chemotherapy and considered curable. In various embodiments, the cancer patient has one or more of a history of blood clots, recent surgery, prolonged periods of bed rest or limited activity, and treatment with a chemotherapeutic agent.

Kits

The invention also provides kits for the administration of any agent described herein (e.g. the chimeric protein or chimeric protein complex with or without various additional therapeutic agents). The kit is an assemblage of materials or components, including at least one of the inventive pharmaceutical compositions described herein. Thus, in some embodiments, the kit contains at least one of the pharmaceutical compositions described herein.

The exact nature of the components configured in the kit depends on its intended purpose. In one embodiment, the kit is configured for the purpose of treating human subjects.

Instructions for use may be included in the kit. Instructions for use typically include a tangible expression describing the technique to be employed in using the components of the kit to effect a desired outcome, such as to treat cancer. Optionally, the kit also contains other useful components, such as, diluents, buffers, pharmaceutically acceptable carriers, syringes, catheters, applicators, pipetting or measuring tools, bandaging materials or other useful paraphernalia as will be readily recognized by those of skill in the art.

The materials and components assembled in the kit can be provided to the practitioner stored in any convenience and suitable ways that preserve their operability and utility. For example, the components can be provided at room, refrigerated or frozen temperatures. The components are typically contained in suitable packaging materials. In various embodiments, the packaging material is constructed by well-known methods, preferably to provide a sterile, contaminant-free environment. The packaging material may have an external label which indicates the contents and/or purpose of the kit and/or its components.

Definitions

As used herein, "a," "an," or "the" can mean one or more than one.

Unless specifically stated or obvious from context, as used herein, the term "or" is understood to be inclusive and covers both "or" and "and".

Further, the term "about" when used in connection with a referenced numeric indication means the referenced numeric indication plus or minus up to 10% of that referenced numeric indication, e.g., within (plus or minus) 10%, 9%, 8%, 7%, 6%, 5%, 4%, 3%, 2%, 1%, 0.5%, 0.1%, 0.05%, or 0.01% of the stated value. For example, the language "about 50" covers the range of 45 to 55.

An "effective amount," when used in connection with medical uses is an amount that is effective for providing a measurable treatment, prevention, or reduction in the rate of pathogenesis of a disease of interest.

As used herein, something is "decreased" if a read-out of activity and/or effect is reduced by a significant amount, such as by at least about 10%, at least about 20%, at least about 30%, at least about 40%, at least about 50%, at least about 60%, at least about 70%, at least about 80%, at least about 90%, at least about 95%, at least about 97%, at least about 98%, or more, up to and including at least about 100%, in the presence of an agent or stimulus relative to the absence of such modulation. As will be understood by one of ordinary skill in the art, in some embodiments, activity is decreased and some downstream read-outs will decrease but others can increase.

Conversely, activity is "increased" if a read-out of activity and/or effect is increased by a significant amount, for example by at least about 10%, at least about 20%, at least about 30%, at least about 40%, at least about 50%, at least about 60%, at least about 70%, at least about 80%, at least about 90%, at least about 95%, at least about 97%, at least about 98%, or more, up to and including at least about 100% or more, at least about 2-fold, at least about 3-fold, at least about 4-fold, at least about 5-fold, at least about 6-fold, at least about 7-fold, at least about 8-fold, at least about 9-fold, at least about 10-fold, at least about 50-fold, at least about 100-fold, in the presence of an agent or stimulus, relative to the absence of such agent or stimulus.

As referred to herein, all compositional percentages are by weight of the total composition, unless otherwise specified. As used herein, the word "include," and its variants, is intended to be non-limiting, such that recitation of items in a list is not to the exclusion of other like items that may also be useful in the compositions and methods of this technology. Similarly, the terms "can" and "may" and their variants are intended to be non-limiting, such that recitation that an embodiment can or may comprise certain elements or features does not exclude other embodiments of the present technology that do not contain those elements or features.

Although the open-ended term "comprising," as a synonym of terms such as including, containing, or having, is used herein to describe and claim the invention, the present invention, or embodiments thereof, may alternatively be described using alternative terms such as "consisting of" or "consisting essentially of."

As used herein, the words "preferred" and "preferably" refer to embodiments of the technology that afford certain benefits, under certain circumstances. However, other embodiments may also be preferred, under the same or other circumstances. Furthermore, the recitation of one or more preferred embodiments does not imply that other embodiments are not useful, and is not intended to exclude other embodiments from the scope of the technology.

The amount of compositions described herein needed for achieving a therapeutic effect may be determined empirically in accordance with conventional procedures for the particular purpose. Generally, for administering therapeutic agents for therapeutic purposes, the therapeutic agents are given at a pharmacologically effective dose. A "pharmacologically effective amount," "pharmacologically effective dose," "therapeutically effective amount," or "effective amount" refers to an amount sufficient to produce the desired physiological effect or amount capable of achieving the desired result, particularly for treating the disorder or disease. An effective amount as used herein would include an amount sufficient to, for example, delay the development of a symptom of the disorder or disease, alter the course of a symptom of the disorder or disease (e.g., slow the progression of a symptom of the disease), reduce or eliminate one or more symptoms or manifestations of the disorder or disease, and reverse a symptom of a disorder or disease. Therapeutic benefit also includes halting or slowing the progression of the underlying disease or disorder, regardless of whether improvement is realized.

Effective amounts, toxicity, and therapeutic efficacy can be determined by standard pharmaceutical procedures in cell cultures or experimental animals, e.g., for determining the LD50 (the dose lethal to about 50% of the population) and the ED50 (the dose therapeutically effective in about 50% of the population). The dosage can vary depending upon the dosage form employed and the route of administration utilized. The dose ratio between toxic and therapeutic effects is the therapeutic index and can be expressed as the ratio LD50/ED50. In some embodiments, compositions and methods that exhibit large therapeutic indices are preferred. A therapeutically effective dose can be estimated initially from in vitro assays, including, for example, cell culture assays. Also, a dose can be formulated in animal models to achieve a circulating plasma concentration range that includes the IC50 as determined in cell culture, or in an appropriate animal model. Levels of the described compositions in plasma can be measured, for example, by high performance liquid chromatography. The effects of any particular dosage can be monitored by a suitable bioassay. The dosage can be determined by a physician and adjusted, as necessary, to suit observed effects of the treatment.

In certain embodiments, the effect will result in a quantifiable change of at least about 10%, at least about 20%, at least about 30%, at least about 50%, at least about 70%, or at least about 90%. In some embodiments, the effect will result in a quantifiable change of about 10%, about 20%, about 30%, about 50%, about 70%, or even about 90% or more. Therapeutic benefit also includes halting or slowing the progression of the underlying disease or disorder, regardless of whether improvement is realized.

As used herein, "methods of treatment" are equally applicable to use of a composition for treating the diseases or disorders described herein and/or compositions for use and/or uses in the manufacture of a medicaments for treating the diseases or disorders described herein.

EXAMPLES

In some Examples, two variants of the knob-in-hole technology are used: Ridgway (derived from Ridgway et al., Protein Engineering 1996; 9:617-621) and Merchant (derived from Merchant et al., Nature Biotechnology 1998; 16:677-681). Sequences are referred to as Fc1 and Fc2 (Ridgway hole and knob, respectively) and Fc3 and Fc4 (Merchant hole and knob, respectively). The 'standard' effector-mutation in the Ridgway constructs is LALA-PG (P329G), unless stated otherwise. For the Merchant constructs the LALA-KQ (K322Q) mutation is used.

Fc1: Ridgway hole: hIgG1 Fc_L234A_L235A_P329G_Y407T having the following amino acid sequence:
(SEQ ID NO: 1461)
DKTHTCPPCPAPEAAGGPSVFLFPPKPKDTLMISRTPEVTCVVVDVSHED

PEVKFNWYVDGVEVHNAKTKPREEQYNSTYRWSVLTVLHQDWLNGKEYKC

KVSNKALPAPIEKTISKAKGQPREPQVYTLPPSRDELTKNQVSLTCLVKG

FYPSDIAVEWESNGQPENNYKTTPPVLDSDGSFFLTSKLTVDKSRWQQGN

VFSCSVMHEALHNHYTQKSLSLSPGK

Fc2: Ridgway knob: hIgG1 Fc_L234A_L235A_P329G_T366Y having the following amino acid sequence:
(SEQ ID NO: 1462)
DKTHTCPPCPAPEAAGGPSVFLFPPKPKDTLMISRTPEVTCVVVDVSHED

PEVKFNWYVDGVEVHNAKTKPREEQYNSTYRWSVLTVLHQDWLNGKEYKC

KVSNKALPAPIEKTISKAKGQPREPQVYTLPPSRDELTKNQVSLYCLVKG

FYPSDIAVEWESNGQPENNYKTTPPVLDSDGSFFLYSKLTVDKSRWQQGN

VFSCSVMHEALHNHYTQKSLSLSPGK

Fc3: Merchant hole:
hIgG1 Fc_L234A_L235A_K322Q_Y349O_T366S_L368A_Y407V having the following amino acid sequence:
(SEQ ID NO: 1463)
DKTHTCPPCPAPEAAGGPSVFLFPPKPKDTLMISRTPEVTCVVVDVSHED

PEVKFNWYVDGVEVHNAKTKPREEQYNSTYRWSVLTVLHQDWLNGKEYKC

KVSNKALPAPIEKTISKAKGQPREPQVCTLPPSRDELTKNQVSLSCAVKG

FYPSDIAVEWESNGQPENNYKTTPPVLDSDGSFFLVSKLTVDKSRWQQGN

VFSCSVMHEALHNHYTQKSLSLSPGK

Fc4: Merchant knob:
hIgG1 Fc_L234A_L235A_K322Q_S354O_T366W having the following amino acid sequence:
(SEQ ID NO: 1464)
DKTHTCPPCPAPEAAGGPSVFLFPPKPKDTLMISRTPEVTCVVVDVSHED

PEVKFNWYVDGVEVHNAKTKPREEQYNSTYRWSVLTVLHQDWLNGKEYKC

KVSNKALPAPIEKTISKAKGQPREPQVYTLPPCRDELTKNQVSLWCLVKG

FYPSDIAVEWESNGQPENNYKTTPPVLDSDGSFFLYSKLTVDKSRWQQGN

VFSCSVMHEALHNHYTQKSLSLSPGK

The terms "AcTaferon" or "AFN" is occasionally used herein to reference an interferon-based chimera.

In the following examples, unless noted, mutations to IFN are relative to human IFN-α2.

Example 1: Treatment of EAE with AFN Targeted to Plasmacytoid and Conventional Dendritic Cells The purpose of this experiment was, inter alia, to assess developed AcTaferons (Activity-on-Target IFNs, "AFN"), IFN-based immunocytokines, for delaying disease via cell-specific targeting without mortality and hematological consequences. The results show that, without limitation, when comparing Clec9A-, XCR1- and SiglecH-targeting, targeting AFN to plasmacytoid (p) and conventional (c) DC is superior and non-toxic compared to WT mIFN.

Experimental Autoimmune Encephalitis (EAE) Model and Treatments

All animal experiments followed the Federation of European Laboratory Animal Science Association (FELASA) guidelines and were approved by the Ethical Committee of Ghent University. Male 8 weeks old C57BI/6J mice were immunized s.c. with 200 µg MOG35-55 in Complete Freund's Adjuvant (CFA) containing 1 mg heat-killed *Mycobacterium tuberculosis*. Two hours and 2 days later 50 ng Pertussis Toxin was injected intraperitoneally. First signs of disease typically started on day 10-12. IFN or AFN intraperitoneal treatments were initiated on day 7 or 12 and lasted till day 25. Mice were daily weighed and scored. A score ranging from 0 to 2 indicates progressive tail paralysis, with 1.5 for a partially limp tail, 2 for a completely limp tail. Score 2.5 was given if the animal no longer spreads its hind toes, score 3 for a waddled walk. Scores above 3 indicate increasing paralysis, with 4 for complete hind limb paralysis. If fore limb paralysis was evident, score 5 was given and the animal was euthanized. Batf3-/- and CD11c-IFNAR1-/- mice were used to determine cDC1 involvement and IFN signaling, anti-PDCA1 treatment (BioXCell, 250 g/mouse given on days 7, 8, 10, 12 after immunization) for pDC contribution. To evaluate immune checkpoint involvement, mice were treated with anti-PDL1 camelid VHH (20 mg/kg daily) or anti-CTLA4 Ab (BioXCell, 10 mg/kg, every 2-3 days). Treatment groups number 5-7, experiments were repeated at least once. Differences were assessed using one-way or two-way ANOVA followed by Dunnett's or Tukey's multiple-comparison test. Survival curves were compared using the log-rank test. GraphPad Prism software was used for statistical analysis. All values depicted are mean±s.e.m.; *$P<0.05$, $P<0.01$, *$P<0.001$ and ****$P<0.0001$ compared with PBS treated animals, unless otherwise indicated.

Generation of AcTaferons

Camelid VHHs binding mouse Clec9A and CD8a were generated. Importantly, they did not interfere with cross-presentation of DC or T cell activation, respectively. In addition, cDC1 were targeted using XCL1, the ligand for XCR1, engineered for better XCR1 binding (removing 25 C-terminal amino acids and mutating V21C and A59C), while pDC were specifically targeted with SiglecH camelid VHHs. The IFNα2 mutant in mice, hIFNαQ124R, is a human IFNα mutant breaching the cross-species barrier and thus weakly active on murine cells (1/100 vs WT mIFNα).

Haematological and FACS Analysis

One day after the last treatment, blood was collected from the tail vein in EDTA-coated microvette tubes (Sarstedt), and analyzed in a Hemavet 950FS whole blood counter (Drew Scientific, Waterbury, USA). Spinal cord sections were dissected and stained with H&E, Luxol fast blue (LFB, for myelination assessment), and antibodies against amyloid precursor protein APP (evaluating axonal damage) or CD3, B220 or MAC-3 for visualizing infiltrating T and B cells and macrophages, respectively. Flow cytometry was done for spleen and lymph node (LN) cells. Doublets were excluded and living cells were selected based on live-dead stain (Invitrogen). pDC (CD3- CD19- B220+ SiglecH+) and cDC1 (CD3- CD19- CD11b- CD11c+ MHCII+ XCR1+ Clec9A+) percentages were determined, and the intracellular expression of designated cytokines determined. For regulatory T cells (Tregs), the CD3+ CD4+ CD25+ FoxP3+ population was analyzed. For regulatory B cells (Bregs), the CD3- CD19+ CD5+ CD1d+ population. Fc receptors were blocked using anti-CD16/CD32 Ab. Fluorescence minus one (FMO) and isotype controls were included to allow adequate analysis. Samples were acquired on an Attune Nxt Acoustic Focusing Cytometer (Life Technologies) and analyzed using FlowJo software.

Results

The results show that Wild Type mIFNα11 dose-dependently protects against EAE, but is associated with severe toxicity. The active EAE model using C57BL/6 mice immunized with MOG35-55 peptide is very robust and uniform and hence widely employed for understanding disease pathology and validating potential novel treatments. In this model, the positive standard was first defined by daily treatment with WT mIFNα11. 5000 IU WT mIFNα had a minor disease-delaying effect (FIG. 1, panels A-B), comparable to mIFNβ effects published before. A very high dose of WT mIFNα (1,000,000 IU) was capable of significantly delaying the onset and progression of disease (FIG. 1, panels A-B), but the treatment itself caused 60% mortality (FIG. 1, panel C) and severe hematological deficits in the 40% surviving mice, including dramatic lymphopenia (FIG. 1, panel D), neutropenia (FIG. 1, panel E), monocytopenia (FIG. 1, panel F), anemia (FIG. 1, panel G), as well as severe thrombocytopenia (FIG. 1, panel H), and increased mean platelet volume (MPV, FIG. 1, panel I), indicative of platelet destruction.

Figure 2:
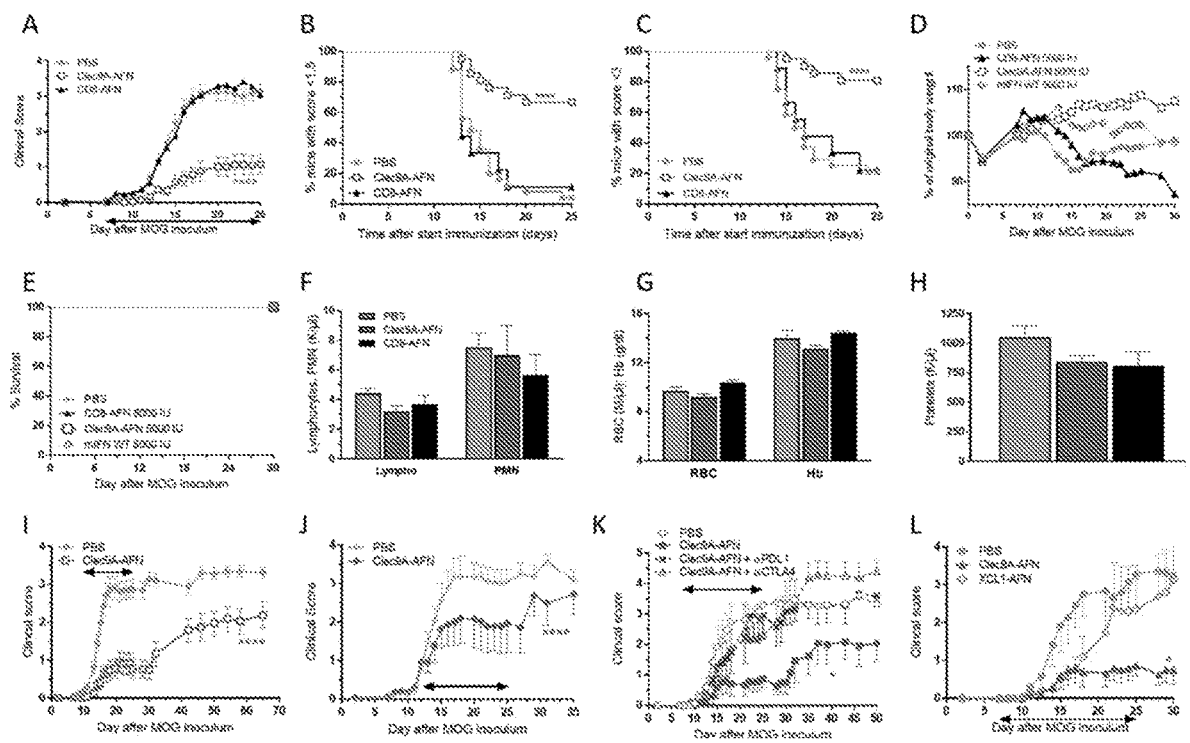
FIG. 2 depicts Clec9A-AFN, but not CD8-AFN, as efficiently protecting against disease without toxicity. Shown are clinical scores (A), % of diseased (B) or paralyzed (C) mice, body weight (D), mortality (E), haematological parameters (F-H). (A-C) Shown are pooled data from 3 experiments (n=15-18), (D-H) shown is a representative experiment (n=5). Clec9A-AFN protection is long lasting (I), effective if started after disease onset (J), reversed by anti-PDL1 or anti-CTLA4 (K), and better than XCL1-AFN treatment (L). (I-L) Shown is a representative experiment (n=6). The black horizontal arrow indicates the treatment period. Differences were assessed using two-way ANOVA followed by Dunnett's multiple-comparison test; *P<0.05, ****P<0.0001 compared with PBS treated animals. In panels F, G, and H, the order of histograms left to right is PBS, Clec9A-AFN, and CD8-AFN.

However, the results further show that targeting IFN activity to DC protects even better than WT mIFNα without the toxicity effects. In the classic MS/EAE scenario, processing and presentation of self-antigen(s) by antigen presenting cells (APC) causes activation and expansion of peripheral T cells. These auto-reactive T cells migrate across the blood brain barrier (BBB), enter the CNS, and induce disease by activating glial cells and attracting and activating other immune cells, ultimately resulting in severe damage of the central neurons and their myelin sheaths and axons. It was long believed that CD4+ T cells are primary inducers and mediators in MS. However, not CD4+ but CD8+ T cells are the predominant population in human MS lesions, and a role for myelin-specific CD8+ T cells was suggested. Intriguingly, these may develop into either cytotoxic or immunosuppressive CD8+ lymphocytes. Several cell types have been suggested to be responsible for the beneficial effects of IFN in MS. These include T lymphocytes and APC such as dendritic cells (DC). To evaluate their involvement, AFN was targeted to CD8+ cells or to Clec9A+DC. In contrast to WT mIFNα, 5000 IU Clec9A-AFN significantly protected (FIG. 2, panels A-D) without mortality (FIG. 2, panel E) or hematological problems (FIG. 2, panels F-H). Interestingly, CD8-AFN had no influence on clinical score, onset of disease, or paralysis (FIG. 2, panel A-C), but had a detrimental effect on body weight loss (FIG. 2, panel D). Notably, Clec9A-AFN treatment provided long-term protection against EAE progression and the development of paralysis (FIG. 2, panel I), also when given after disease onset (FIG. 2, panel J).

The results show, inter alia, that DC-targeted protection is dependent on PDL-1 and CTLA-4. For APC to activate T lymphocytes, a well-defined set of interactions and signals is necessary. Positive signals include TCR-MHC/antigen interaction, binding of costimulatory molecules (CD28-CD80/CD86), and the production of stimulatory cytokines. However, the absence of negative interactions (immune checkpoints) is at least equally important. In MS patients, IFNβ therapy increases PDL-1 levels. In addition, blocking CTLA-4 can exacerbate EAE sensitivity or induce EAE sensitivity in non-susceptible mice. Hence, Clec9A-AFN treated EAE mice were treated simultaneously with neutralizing anti-PDL1 camelid VHHs, or anti-CTLA-4 Abs. Both immune checkpoint inhibitors prevented the protective effect of Clec9A-AFN (FIG. 2, panel K).

Figure 3:
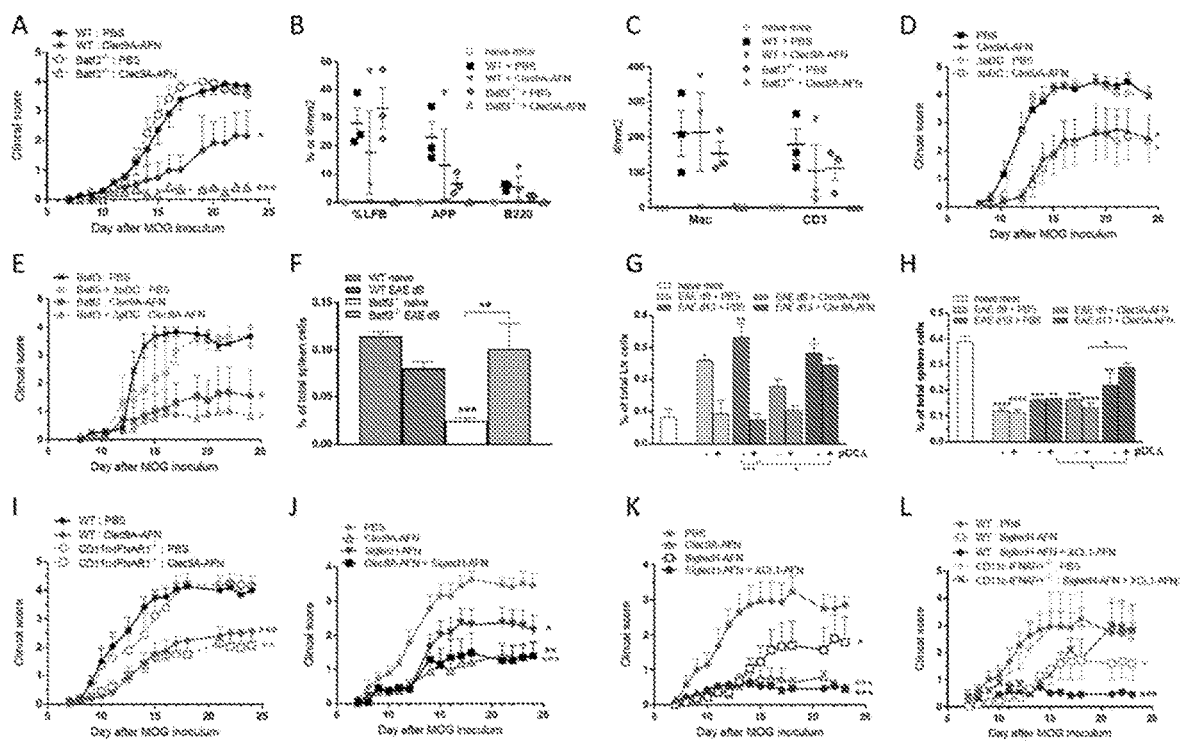
FIG. 3 depicts pDC targeting inhibiting disease development. Clec9A-AFN protects in Batf3$^{-/-}$ (A-C), and in (partially) pDC-depleted mice (D, E). Shown are the clinical scores, n=5 (A, D, E) and spinal cord analysis, n=3 (B,C) to evaluate demyelination (LFB), axonal damage (APP), B cells (B220), macrophages (Mac) and T cells (CD3). However, EAE in Batf3$^{-/-}$ causes compensatory cDC1 development (F, n=4), and pDC depletion in LNs is not evident in case of Clec9A-AFN therapy (G) or in spleens (H), n=3. (G,H) Plus and minus signs under the X axis indicate pDC depletion treatments (+) or not (−). CD11c-IFNAR1$^{-/-}$ are still protected by Clec9A-AFN (I). Selective pDC targeting with SiglecH-AFN is as effective as Clec9A-AFN during initial EAE phase (J, n=6) and aided by XCL1-AFN later (K, n=6), but not in CD11c-IFNAR1$^{-/-}$ (L, n=6). Shown are representative experiments (A-H, J-L), or pooled results from 3 independent experiments (I, n=10). Differences were assessed using one-way or two-way ANOVA followed by Tukey's multiple-comparison test; *P<0.05, P<0.01, *P<0.001 compared with PBS treated animals, unless otherwise indicated.

The results further show that DC-targeted protection is mainly mediated by pDC. DCs are typically divided in three major subsets: Clec9A$^+$ XCR1$^+$ type 1 conventional/myeloid DC (cDC1), CD11b$^+$ SIRPα$^+$ type 2 conventional/myeloid DC (cDC2), and plasmacytoid pDC. In humans, only cDC1 are Clec9A+. In mice, however, not only XCR1$^+$ cDC1, but also pDC are Clec9A$^+$. To verify the involvement of the XCR1$^+$ cDC1, they were specifically targeted using XCL1-AFN. Surprisingly, comparison of Clec9A-AFN and XCL1-AFN indicated that not only cDC1 but also pDC may be important (FIG. 2, panel L). As cDC1 specifically require the Batf3 transcription factor for their differentiation, deletion of Batf3 ablates their development. Experiments in Batf3$^{-/-}$ mice indicated not only their susceptibility for EAE, but also the ability of Clec9A-AFN to prevent disease progression, spinal cord damage and inflammation in Batf3$^{-/-}$ animals even better than in WT mice (FIG. 3, panel A-C), suggesting the critical involvement of pDC rather than cDC1. Consequently, pDC were depleted using anti-PDCA1 antibodies. Unexpectedly, pDC depletion did not affect Clec9A-AFN protection, not in WT mice (FIG. 3, panel D), but also not in Batf3$^{-/-}$ mice (FIG. 3, panel E). To clarify these results, the presence of cDC1 and pDC were analyzed in the various mice and experimental conditions described in this Example 1. Surprisingly, whereas naive Batf3$^{-/-}$ mice were indeed cDC1-deficient, cDC1 were present in the EAE-developing Batf3$^{-/-}$ animals (FIG. 3, panel F), probably due to compensatory Batf-induced cDC1 development, which has already been reported in response to intracellular pathogens, mediated by IL-12 and IFN-γ. Hence, the results obtained in Batf3$^{-/-}$ mice are not conclusive with regard to cDC1 involvement. In addition, when analyzing pDC after anti-PDCA1 treatment, evidence was found for pDC depletion in lymph nodes (LNs) during EAE progression in mice receiving PBS therapy (FIG. 3, panel G), but not in spleens (FIG. 3, panel H), or in LNs of mice treated with Clec9A-AFN (FIG. 3, panel G). Together, these results indicate that the pDC depletion experiments cannot provide conclusive interpretations either. Nevertheless, in CD11c-IFNAR1$^{-/-}$ mice, where IFNAR1 and IFN signaling are absent in cDC but present in pDC, Clec9A-AFN can still protect, clearly providing evidence for critical pDC involvement in Clec9A-AFN mediated protection.

However, the results further show that targeting pDC is superior to targeting cDC1. To further corroborate the involvement of cDC1 versus pDC, camelid VHHs specific for SiglecH, a validated pDC marker in mice were generated. As Clec4C resembles SiglecH in that it is a marker for pDCs, it can be considered to be a human surrogate of SiglecH.

SiglecH-AFN treatment was equally proficient as Clec9A-AFN to protect against EAE development, at least till day 12 (FIG. 3, panel J). Combining SiglecH-AFN with Clec9A-AFN did not add to Clec9A-AFN efficacy (FIG. 3, panel J). These results suggest the critical early involvement of pDC, as well as the additional need for cDC1 later during disease progression. To investigate this possibility, XCL1-AFN (targeting only cDC1) was added to the SiglecH-AFN therapy (targeting only pDC), starting on day 11. Additional XCL1-AFN treatments enabled SiglecH-AFN therapy to become as effective as Clec9A-AFN (FIG. 3, panel K). Corroborating the specificity of XCL1-AFN, its additive effect on SiglecH-AFN therapy was absent in CD11c-IFNAR1−/− mice that lack IFNAR1 on cDC only (FIG. 3, panel L). Thus, targeting IFN activity to pDC and cDC1, using DC-specific AFNs, can very efficiently protect against EAE progression, without the development of toxic side effects.

Figure 4:
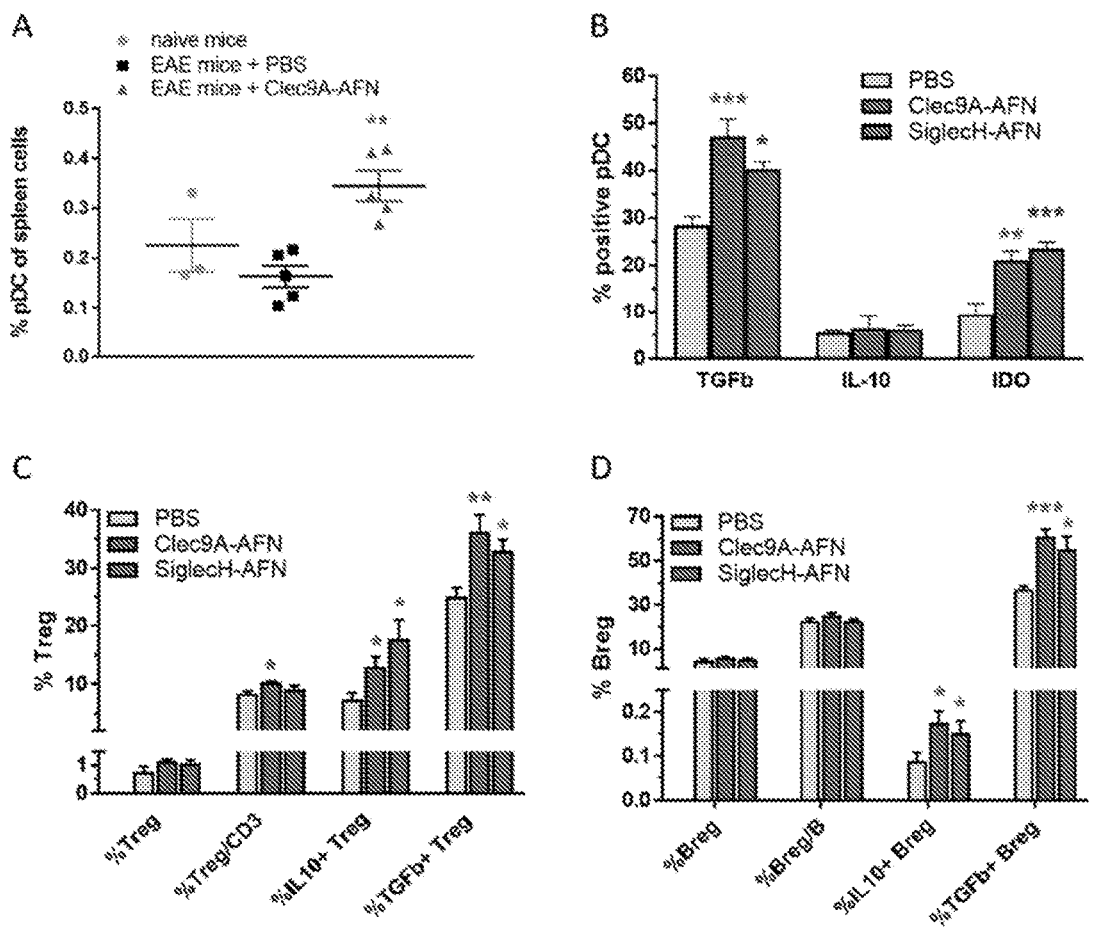
FIG. 4 depicts protective treatments produce tolerogenic pDC, Tregs and Bregs. Amounts of splenic pDC were increased on d12 (A), and more of them produced TFGb and IDO, but not IL-10 (B, n=4-5). Tregs were increased by Clec9A-AFN if counted within the CD3$^+$ population (C, n=5). Both in the Treg and Breg population, the % of IL-10 or TGFβ producing cells increased (C, D, n=5). Differences were assessed using one-way ANOVA followed by Dunnett's multiple-comparison test; *P<0.05, P<0.01, *P<0.001 compared with PBS treated animals.
Figure 5:
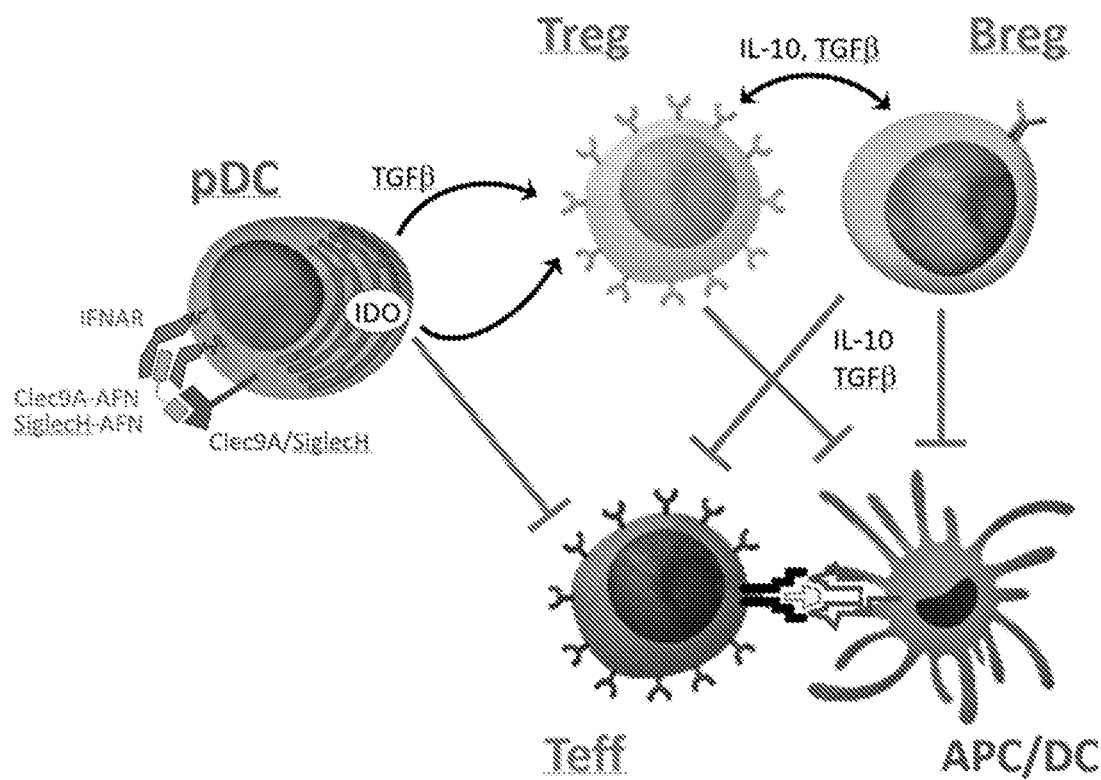
FIG. 5 shows, without wishing to be bound by theory, a non-limiting schematic of AFN targeting and the proposed tolerizing effects during EAE. Targeting AFN via Clec9A or SiglecH to pDC tolerizes them, increasing their TGFβ and IDO expression. TGFβ and IDO-induced kynurenine synthesis are known to induce Tregs, while IDO-induced tryptophan catabolism inhibits Teff. Tregs and Bregs may increase each other's immunosuppressive effects via IL-10 and TGFβ; the latter will also inhibit immunogenic Teff and self-antigen presenting cells such as DC.

The results also show that targeting DC induces a systemic tolerogenic response. To evaluate how DC-targeted AFN could provide protection in EAE, pDC and cDC1 numbers were analyzed as well as tolerization markers, and evidence of additional tolerogenic cells. While splenic pDC numbers were increased after Clec9A-AFN (FIG. 3, panel H and FIG. 4, panel A), there was no increase in LN (FIG. 3, panel G). Determination of SiglecH$^+$ pDC numbers after SiglecH-AFN treatment showed very little pDC, probably due to the endocytic nature of SiglecH, which is very efficiently internalized after engagement. To analyze the tolerogenic nature of the pDCs, their production of the potent immunosuppressive determinants TGFβ, IL-10, and indoleamine 2,3-dioxygenase (IDO) was determined. While there was no increase in IL-10, Clec9A-AFN and SiglecH-AFN robustly enhanced both TGFβ and IDO in splenic pDC (FIG. 4, panel B). In contrast to pDC, cDC1 numbers were not different in spleen or LNs (not shown). To dampen immune responses, also other regulatory cell types such as Treg and/or Breg may be involved. Treg numbers were increased in spleens of Clec9A-AFN treated EAE mice, and the percentage of TGFβ and IL-10 producing Tregs was enhanced by both Clec9A-AFN and SiglecH-AFN (FIG. 4, panel C). While Breg numbers were not statistically increased, significantly more of them produced immunosuppressive IL-10 and TGFβ (FIG. 4, panel D). Together, these data indicate a strong and systemic tolerizing effect of DC-targeted AFNs (FIG. 5)

In conclusion, the results support the development of a novel, generic and safe strategy for the in vivo tolerization of DCs as a successful means to control autoimmunity. Indeed, targeting IFN activity specifically to pDC (and later also cDC1) during EAE induced a strong tolerogenic phenotype, evident in both pDC, Treg and Breg, that efficiently dampened EAE disease progression without toxic side effects. DC-specific targeting of IFN activity not only abolished all systemic adverse effects and toxicities, it also dissected positive from negative IFN effects and may thus represent a better and harmless MS therapy.

Example 2: Generation and Characterization of Human Clec4C VHH

The extracellular domain of human Clec4C (aa 45-213; SEQ ID 1226) was amplified and cloned in the pMET7 expression-vector as follows: pMET7-SIgK-His-Clec4C (EC). The resulting plasmid was transfected in Hek293F cells (ThermoFisher) using PEI 25K. After 5-6 days, supernatant was collected after centrifugation of cells and filterfiltration. Recombinant proteins were purified using Ni Excell resin (GE Healthcare) according to the manufacturer's guidelines and imidazole removed from elution fractions using PD-10 columns (GE Healthcare).

Sequence of extracellular domain of human CLEC4C (aa 45-213):

(SEQ ID NO: 1226)
NFMYSKTVKRLSKLREYQQYHPSLTCVMEGKDIEDWSCCPTPWTSFQSSC

YFISTGMQSWTKSQKNCSVMGADLVVINTREEQDFIIQNLKRNSSYFLGL

SDPGGRRHWQWVDQTPYNENVTFWHSGEPNNLDERCAIINFRSSEEWGWN

DIHCHVPQKSICKMKKIYI.

A llama was subcutaneously injected on days 0, 7, 14, 21, 28 and 35, each time with about 150 µg of recombinant His6-tagged extracellular domain of human Clec4C (C-type lectin domain family 4, member C) emulsified with Gerbu adjuvant P. On day 40, anticoagulated blood was collected from the llama for lymphocyte preparation.

A VHH library was constructed from the llama to screen for the presence of antigen-specific VHH. To this end, total RNA from peripheral blood lymphocytes was used as template for first strand cDNA synthesis with an oligo(dT) primer. Using this cDNA, the VHH encoding sequences were amplified by PCR, digested with PstI and NotI, and cloned into the PstI and NotI sites of the phagemid vector pMECS. The VHH library thus obtained was called Core S and consists of about 10E08 independent transformants. About 84% of transformants harbored the vector with the right insert size.

The Core S library was panned on solid-phase coated antigen (120 µg/ml PBS, 12 µg/well) for 3 rounds using the same antigen as for immunization. The enrichment for antigen-specific phages was assessed after each round of panning by comparing the number of phagemid particles eluted from antigen-coated wells with the number of phagemid particles eluted from negative control (uncoated blocked) wells. These experiments suggested that the phage population was enriched for antigen-specific phages about 10-fold, 10-fold and 103-fold after 1st, 2nd and 3rd rounds, respectively.

The VHH gene cloned in pMECS vector contains PelB signal sequence at the N-terminus and HA tag and His6 tag at the C-terminus (PelB leader-VHH-HA-His6). The PelB leader sequence directs the VHH to the periplasmic space of the *E. coli* and the HA and His6 tags can be used for the purification and detection of the VHH (e.g., in ELISA, Western Blot, etc.). In the pMECS vector, the His6 tag was followed by an amber stop codon (TAG) and this amber stop codon is followed by gene III of M13 phage. In suppressor *E. coli* strains (e.g., TG1), the amber stop codon was read as glutamine and therefore the VHH was expressed as fusion protein with protein III of the phage, which allows the display of the VHH on the phage coat for panning. In TG1 suppressor strains, the efficiency of suppression is not 100% and therefore the expression of VHHs in suppressor strains lead to two different types of VHH molecules, i.e., fused to protein III and without protein III). In non-suppressor *E. coli* strains (e.g., WK6), the amber stop codon was read as stop codon and therefore the resulting VHH was not fused to protein III.

In total, 190 colonies from rounds 1 and 2 were randomly selected and analyzed by ELISA for the presence of antigen-specific VHH in their periplasmic extracts (ELISA using crude periplasmic extracts from TG1 cultures including soluble VHH). The antigen used for ELISA screening was the same as the one used for immunization, using uncoated blocked wells as negative control. Out of these colonies, 62 scored positive in this assay. Based on sequence data of the positive colonies, 52 different full length VHH were distinguished (SEQ ID Nos: 1400-1451). Table 7 shows the ELISA results of these 52 unique VHHs genes that encode human CLE4C binding agents. The 52 VHH belong to 28 different CDR3 groups of which groups 9-28 consist of a single member (see Table 8).

TABLE 7

| *E. coli* strain + Vector | VHH | ELISA coated | ELISA uncoated | ELISA ratio coated/uncoated |
|---|---|---|---|---|
| TG1, pMECS | 1CL21 | 3.7933 | 0.3414 | 11.11 |
| TG1, pMECS | 1CL25 | 4 | 0.6885 | 5.81 |
| TG1, pMECS | 1CL48 | 3.8539 | 0.4925 | 7.83 |
| TG1, pMECS | 1CL72 | 3.7271 | 0.1087 | 34.29 |
| TG1, pMECS | 2CL4 | 2.797 | 0.0893 | 31.32 |
| TG1, pMECS | 2CL8 | 1.8108 | 0.1153 | 15.71 |
| TG1, pMECS | 2CL41 | 4 | 0.1918 | 20.86 |
| TG1, pMECS | 2CL72 | 3.632 | 0.1691 | 21.48 |
| TG1, pMECS | 2CL78 | 3.7525 | 0.1147 | 32.72 |
| TG1, pMECS | 2CL87 | 1.6153 | 0.1402 | 11.52 |
| TG1, pMECS | 2CL88 | 4 | 0.3278 | 12.20 |
| TG1, pMECS | 2CL90 | 4 | 0.5306 | 7.54 |
| TG1, pMECS | 2CL95 | 4 | 0.1721 | 23.24 |
| TG1, pMECS | 1CL54 | 1.8838 | 0.1111 | 16.96 |
| TG1, pMECS | 2CL52 | 1.6522 | 0.2337 | 7.07 |
| TG1, pMECS | 1CL2 | 3.7388 | 0.8585 | 4.36 |
| TG1, pMECS | 1CL32 | 3.2159 | 0.3247 | 9.90 |
| TG1, pMECS | 2CL58 | 2.2413 | 0.4806 | 4.66 |
| TG1, pMECS | 2CL73 | 2.4322 | 0.4931 | 4.93 |
| TG1, pMECS | 2CL43 | 2.6353 | 0.2179 | 12.09 |
| TG1, pMECS | 2CL82 | 2.6766 | 0.2747 | 9.74 |
| TG1, pMECS | 2CL89 | 1.3141 | 0.1233 | 10.66 |
| TG1, pMECS | 2CL25 | 4 | 0.3395 | 11.78 |
| TG1, pMECS | 2CL84 | 3.8636 | 0.2117 | 18.25 |
| TG1, pMECS | 2CL92 | 3.8915 | 0.3423 | 11.37 |
| TG1, pMECS | 2CL21 | 3.8879 | 0.9189 | 4.23 |
| TG1, pMECS | 2CL30 | 3.7936 | 0.4581 | 8.28 |
| TG1, pMECS | 2CL71 | 4 | 0.75 | 5.33 |
| TG1, pMECS | 2CL7 | 0.6645 | 0.1011 | 6.57 |
| TG1, pMECS | 2CL18 | 0.4906 | 0.1036 | 4.74 |
| TG1, pMECS | 2CL26 | 4 | 0.1868 | 21.41 |
| TG1, pMECS | 2CL55 | 1.7011 | 0.1132 | 15.03 |
| TG1, pMECS | 1CL47 | 4 | 0.4084 | 9.79 |
| TG1, pMECS | 2CL59 | 3.7627 | 0.9455 | 3.98 |
| TG1, pMECS | 2CL16 | 2.0274 | 0.1436 | 14.12 |
| TG1, pMECS | 2CL91 | 4 | 0.7192 | 5.56 |
| TG1, pMECS | 2CL15 | 3.8975 | 0.3058 | 12.75 |
| TG1, pMECS | 2CL81 | 3.6877 | 0.4433 | 8.32 |
| TG1, pMECS | 1CL81 | 1.1235 | 0.2381 | 4.72 |
| TG1, pMECS | 1CL56 | 3.8879 | 0.8064 | 4.82 |
| TG1, pMECS | 2CL40 | 3.1091 | 0.2329 | 13.35 |
| TG1, pMECS | 2CL65 | 1.7198 | 0.1844 | 9.33 |
| TG1, pMECS | 2CL57 | 0.9217 | 0.2102 | 4.38 |
| TG1, pMECS | 2CL56 | 0.9988 | 0.2118 | 4.72 |
| TG1, pMECS | 2CL66 | 2.0369 | 0.1098 | 18.55 |
| TG1, pMECS | 2CL34 | 2.7959 | 0.7309 | 3.83 |
| TG1, pMECS | 2CL46 | 3.2996 | 0.6846 | 4.82 |
| TG1, pMECS | 2CL29 | 2.2445 | 0.3281 | 6.84 |
| TG1, pMECS | 1CL88 | 4 | 1.168 | 3.42 |
| TG1, pMECS | 2CL68 | 0.4863 | 0.1004 | 4.84 |
| TG1, pMECS | 1CL82 | 3.0071 | 0.4826 | 6.23 |
| TG1, pMECS | 2CL49 | 2.2761 | 0.3207 | 7.10 |

TABLE 8

| Group | Member(s) |
|---|---|
| 1 | 1CL21, 1CL25, 1CL48, 1CL72, 2CL4, 2CL8, 2CL41, 2CL72, 2CL78, 2CL87, 2CL88, 2CL90, 2CL95 |
| 2 | 1CL54, 2CL52 |
| 3 | 1CL2, 1CL32, 2CL58, 2CL73 |
| 4 | 2CL43, 2CL82, 2CL89 |
| 5 | 2CL25, 2CL84, 2CL92 |
| 6 | 2CL21, 2CL30, 2CL71 |
| 7 | 2CL7, 2CL18 |
| 8 | 2CL26, 2CL55 |

TABLE 8-continued

| Group | Member(s) |
|---|---|
| 9-28 | 1CL47, 2CL59, 2CL16, 2CL91, 2CL15, 2CL81, 1CL81, 1CL56, 2CL40, 2CL65, 2CL57, 2CL56, 2CL66, 2CL34, 2CL46, 2CL29, 1CL88, 2CL68, 1CL82, 2CL49 |

Sequence Analysis of VHH

In total, 4 clones have either an internal amber or opal stop codon (1CL72, 2CL68, 2CL49 and 2CL25). For expression in prokaryotic strains (other than suppressor E. coli strains such as TG1) or for expression in eukaryotic cells mutation of the stop codon to a typical VHH consensus sequence at this site can be introduced to ensure processing to full length protein. Such corrected sequences for the VHH 1CL72, 2CL68, 2CL49 and 2CL25 are referred to as SEQ ID NOs: 1452-1455, respectively.

Characterization of Human Clec4C

Expression-vectors (pMECS) encoding the 52 human Clec4C binding VHH's were transformed to WK6 cells. VHH's (with a C-terminal His-tag) were expressed in periplasmic extracts upon IPTG overnight stimulation. These extracts were applied in a FACS binding-assay: Hek293T cells were transiently transfected with a full length human Clec4C plasmid (pMET7 FLAG-huClec4C) or an empty vector. Two days after transfections, cells were resuspended and incubated with a 1 over 5 dilution periplasmic extracts in FACS buffer (PBS+0.5 mM EDTA+3% FBS). VHH binding was detected using a FITC-coupled anti-His Ab (Genscript). Samples were acquired with a FACS Calibur (BD Biosciences), with the CellQuest Pro Version 4.0.2 software (BD Biosciences) and analyzed using the FlowJo software (FlowJo).

Figure 6:
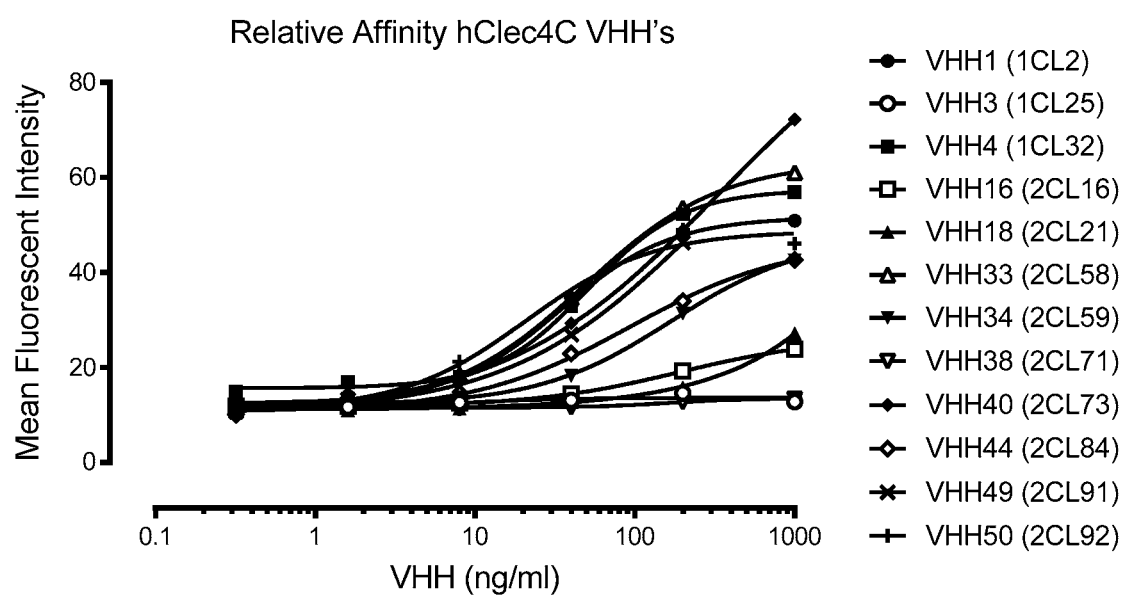
FIG. 6 depicts binding measurements in FACS of twelve selected VHH's to full length human Clec4C expressed in Hek293T. The mean fluorescence intensities were plotted as a function of the VHH concentration.

Based on two such binding-assays, twelve VHH's (1CL2, 1CL25, 1CL32, 2CL16, 2CL21, 2CL58, 2CL59, 2CL71, 2CL73, 2CL84, 2CL91 and 2CL92) were selected and cloned in the pHEN6C expression vector as follows: pHEN6C-PelB-Clec4C VHH-(His)$_6$. Proteins were produced overnight in E coli upon IPTG stimulation and purified from periplasmic extracts using the TALON metal affinity resin (Clontech) according to the manufacturer's instructions. Binding of these purified to Clec4C was measured as described above. In brief: Clec4C transfected cells were incubated with a serial dilation (as indicated) VHH and binding was monitored using a FITC coupled anti-HisAb. Data are summarized in FIG. 6 and confirm VHH from sequence groups 3, 5, 6, 10 (2CL59), 11 (2CL16) and 12 (2CL91) to be binding agents for human CLE4C expressed on a cell membrane. Note that VHH 2CL25 (group 5) was not analyzed because of the presence of the opal stop codon in the sequence (see example 2).

Example 3: Clec4C VHH-Based Fc AFNs

In this Example, a Clec4C targeted Fc AFN based on a human Clec4C specific VHH (clone 2CL92) for targeting to plasmacytoid dendritic cell was generated and evaluated.

Constructs:
Clec4C VHH-20*GGS-Fc3 (P-1571)
(SEQ ID NO: 1465)
QVQLQESGGGSVQAGDSLRLSCAASGRTFSGYAMGWFRQAPGKEREFVAT

ISTSGSSTYYADSVKGRFTISRDNAKKSVYLQINSLKTEDAAVYYCAARL

SFDNTAFYTSAIRYSYWGQGTQVTVSSGGSGGSGGSGGSGGSGGSGGSGG

SGGSGGSGGSGGSGGSGGSGGSGGSGGSGGSGGSGGSDKTHTCPPCPAPE

AAGGPSVFLFPPKPKDTLMISRTPEVTCWVDVSHEDPEVKFNWYVDGVEV

HNAKTKPREEQYNSTYRVVSVLTVLHQDWLNGKEYKCQVSNKALPAPIEK

TISKAKGQPREPQVCTLPPSRDELTKNQVSLSCAVKGFYPSDIAVEWESN

GQPENNYKTTPPVLDSDGSFFLVSKLTVDKSRWQQGNVFSCSVMHEALHN

HYTQKSLSLSPGK

Fc4-20*GGS-IFNa2_R149A (P-1414)
(SEQ ID NO: 1466)
DKTHTCPPCPAPEAAGGPSVFLFPPKPKDTLMISRTPEVTCVVVDVSHED

PEVKFNWYVDGVEVHNAKTKPREEQYNSTYRVVSVLTVLHQDWLNGKEYK

CQVSNKALPAPIEKTISKAKGQPREPQVYTLPPCRDELTKNQVSLWCLVK

GFYPSDIAVEWESNGQPENNYKTTPPVLDSDGSFFLYSKLTVDKSRWQQG

NVFSCSVMHEALHNHYTQKSLSLSPGKGGSGGSGGSGGSGGSGGSGGSGG

SGGSGGSGGSGGSGGSGGSGGSGGSGGSGGSGGSGGSCDLPQTHSLGSRR

TLMLLAQMRKISLFSCLKDRHDFGFPQEEFGNQFQKAETIPVLHEMIQQI

FNLFSTKDSSAAWDETLLDKFYTELYQQLNDLEACVIQGVGVEETPLMKE

DSILAVRKYFQRITLYLKEKKYSPCAWEVVRAEIMASFSLSTNLQESLRS

KE

Production and Purification of Clec4C VHH-Based AFN

Constructs Clec4C VHH-20*GGS-Fc3 and Fc4-20*GGS-IFNα2_R149A were combined to a heterodimeric AFN (for a schematic representation, see FIG. 8(A)) and transiently expressed in the ExpiCHO expression system (Thermo Fisher) according to the manufacturer's guidelines. One week after transfection, supernatant was collected and cells removed by centrifugation. Recombinant proteins were purified from the supernatant using the Pierce Protein A spin plates (Thermo Fisher).

Biological Activity on HL116 Reporter Cell-Lines

Figure 7:
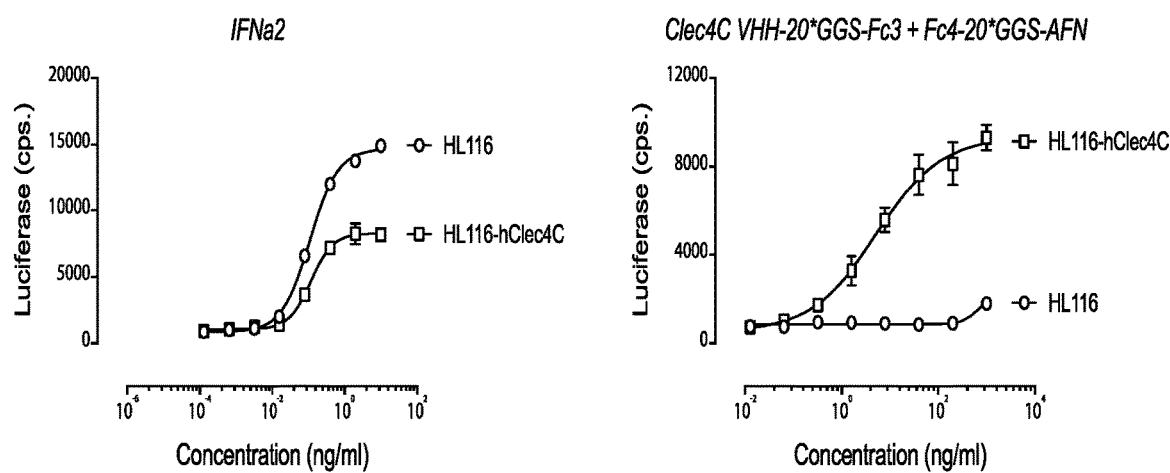
FIG. 7 shows biological activity of IFNa2 and Clec4C VHH Fc AFN on HL116 and HL116-hClec4C cells. Parental HL116 or the derived HL116-hClec4C cells were stimulated for 6 hours with a serial dilution of Fc AFNs. Average luciferase values (±STDEV) of triplicate measurements are plotted.

The HL116 clone is derived from the human HT1080 cell line (ATCC CCL-121). It contains the firefly luciferase gene controlled by the IFN-inducible 6-16 promoter. Parental HL116 cells were transfected with an expression vector encoding the human Clec4C sequence. Stable transfected clones were selected in G418-containing medium. Parental HL116 and HL116-hClec4C cells were seeded overnight at 20,000 cells per 96-well and subsequently stimulated with a serial dilution of Fc AFNs for 6 hours. Luciferase activity was measured in cell lysates. Data in the FIG. 7 illustrate that both cell-lines are comparably sensitive to wild type IFNα2, while the Clec4C Fc AFN is much more active on targeted cells (HL116-hClec4C) compared to untargeted cells (parental HL116).

Example 4: Bispecific Clec4C Targeted Fc AFNs

In this Example, we generated and evaluated Fc AFNs targeting both Clec4C (marker for plasmacytoid dendritic cells) and CD8 (T cell subset). For targeting, we used two VHHs: 2CL92 (human Clec4C specific) and 1CDA65 (human CD8 specific). The bispecific format was compared with the monospecific Fc AFNs for biological activity on target expressing HL116 cells.

Constructs:
Clec4C VHH-20*GGS-Fc3 (P-1571)
(SEQ ID NO: 1467)
QVQLQESGGGSVQAGDSLRLSCAASGRTFSGYAMGWFRQAPGKEREFVAT

ISTSGSSTYYADSVKGRFTISRDNAKKSVYLQINSLKTEDAAVYYCAARL

SFDNTAFYTSAIRYSYWGQGTQVTVSSGGSGGSGGSGGSGGSGGSGGSGG

SGGSGGSGGSGGSGGSGGSGGSGGSGGSGGSGGSGGSDKTHTCPPCPAPE

AAGGPSVFLFPPKPKDTLMISRTPEVTCVVVDVSHEDPEVKFNWYVDGVE

VHNAKTKPREEQYNSTYRVVSVLTVLHQDWLNGKEYKCQVSNKALPAPIE

KTISKAKGQPREPQVCTLPPSRDELTKNQVSLSCAVKGFYPSDIAVEWES

NGQPENNYKTTPPVLDSDGSFFLVSKLTVDKSRWQQGNVFSCSVMHEALH

NHYTQKSLSLSPGK

CD8 VHH-20*GGS-Fc3 (P-1568)
(SEQ ID NO: 1468)
QVQLQESGGGLVHPGGSLRLSCAASGRSFSSYFMGWFRQAPGKEREFVAG

IGWNDGSINYADSVKGRFTISRDNAKNTGYLQMNSLKPEDTAVYYCAASV

SLYGLEKSSAYTSWGQGTQVTVSSGGSGGSGGSGGSGGSGGSGGSGGSGG

SGGSGGSGGSGGSGGSGGSGGSGGSGGSGGSGGSDKTHTCPPCPAPEAAG

GPSVFLFPPKPKDTLMISRTPEVTCVVVDVSHEDPEVKFNWYVDGVEVHN

AKTKPREEQYNSTYRVVSVLTVLHQDWLNGKEYKCQVSNKALPAPIEKTI

SKAKGQPREPQVCTLPPSRDELTKNQVSLSCAVKGFYPSDIAVEWESNGQ

PENNYKTTPPVLDSDGSFFLVSKLTVDKSRWQQGNVFSCSVMHEALHNHY

TQKSLSLSPGK

Fc4-20*GGS-IFNa2_R149A (P-1414)
(SEQ ID NO: 1469)
DKTHTCPPCPAPEAAGGPSVFLFPPKPKDTLMISRTPEVTCVVVDVSHED

PEVKFNWYVDGVEVHNAKTKPREEQYNSTYRVVSVLTVLHQDWLNGKEYK

CQVSNKALPAPIEKTISKAKGQPREPQVYTLPPCRDELTKNQVSLWCLVK

GFYPSDIAVEWESNGQPENNYKTTPPVLDSDGSFFLYSKLTVDKSRWQQG

NVFSCSVMHEALHNHYTQKSLSLSPGKGGSGGSGGSGGSGGSGGSGGSGG

SGGSGGSGGSGGSGGSGGSGGSGGSGGSGGSGGSCDLPQTHSLGSRR

TLMLLAQMRKISLFSCLKDRHDFGFPQEEFGNQFQKAETIPVLHEMIQQI

FNLFSTKDSSAAWDETLLDKFYTELYQQLNDLEACVIQGVGVEETPLMKE

DSILAVRKYFQRITLYLKEKKYSPCAWEVVRAEIMASFSLSTNLQESLRS

KE

CD8 VHH-20*GGS-Fc4-20*GGS-IFNa2_R149A (P-1628)
(SEQ ID NO: 1470)
QVQLQESGGGLVQPGGSLRLSCAASGSIFSINVMGWYRQTPGKERELVAK

ITNFGITSYADSAQGRFTISRGNAKNTVYLQMNSLKPEDTAVYYCNLDTT

GWGPPPYQYWGQGTQVTVSSGGSGGSGGSGGSGGSGGSGGSGGSGGSGGS

GGSGGSGGSGGSGGSGGSGGSGGSGGSDKTHTCPPCPAPEAAGGPSV

FLFPPKPKDTLMISRTPEVTCVVVDVSHEDPEVKFNWYVDGVEVHNAKTK

PREEQYNSTYRVVSVLTVLHQDWLNGKEYKCQVSNKALPAPIEKTISKAK

GQPREPQVYTLPPCRDELTKNQVSLWCLVKGFYPSDIAVEWESNGQPENN

YKTTPPVLDSDGSFFLYSKLTVDKSRWQQGNVFSCSVMHEALHNHYTQKS

LSLSPGKGGSGGSGGSGGSGGSGGSGGSGGSGGSGGSGGSGGSGGSGGSG

GSGGSGGSGGSGGSGGSCDLPQTHSLGSRRTLMLLAQMRKISLFSCLKDR

HDFGFPQEEFGNQFQKAETIPVLHEMIQQIFNLFSTKDSSAAWDETLLDK

FYTELYQQLNDLEACVIQGVGVEETPLMKEDSILAVRKYFQRITLYLKEK

KYSPCAWEVVRAEIMASFSLSTNLQESLRSKE

Production and Purification of Clec4C and CD8 VHH-Based AFNs

The following combinations were transiently transfected in ExpiCHO cells:
(i) Clec4C VHH-Fc3+Fc4-IFNα2_R149A (Clec4C specific AFN; scheme: FIG. 8(A));
(ii) CD8 VHH-Fc3+Fc4-IFNα2_R149A (Clec4C specific AFN; scheme: FIG. 8(B));
(iii) Clec4C VHH-Fc3+CD8 VHH-Fc4-IFNα2_R149A (bi-specific AFN; scheme: FIG. 8(C)).

One week after transfection, supernatant was collected and cells removed by centrifugation. Recombinant proteins were purified from the supernatant using the Pierce Protein A spin plates (Thermo Fisher).

Biological Activity on HL116 Reporter Cell-Lines

Figure 8:
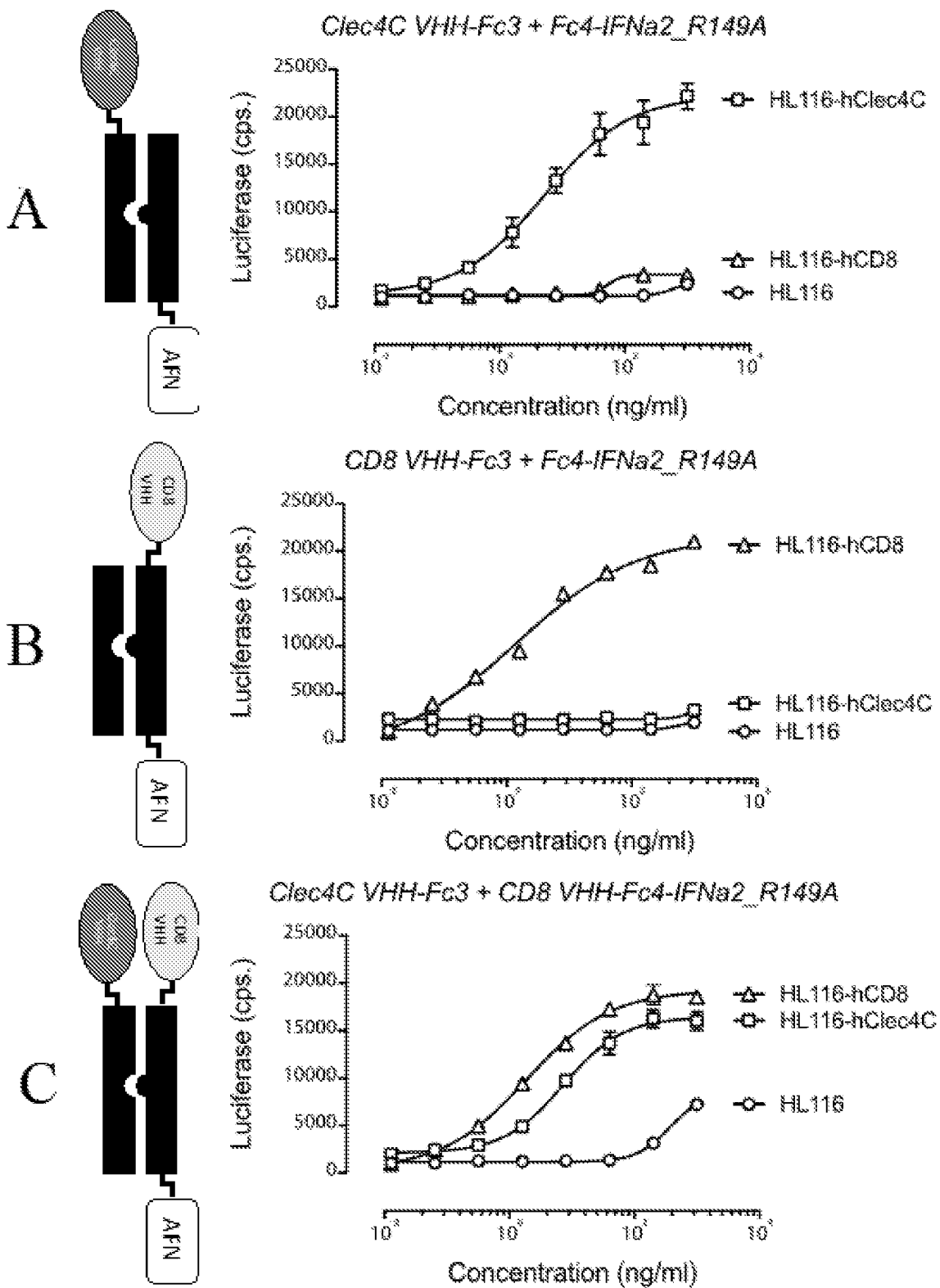
FIGS. 8A-C show schematic representation and biological activity of bi-specific Clec4C-CD8 Fc AFN variants (FIG. 8C) as well as monospecific CLEC4C Fc AFN (FIG. 8A) and monospecific CD8 Fc-AFN (FIG. 8B). Parental HL116, HL116-hClec4C and HL116-hCD8 cells were stimulated for 6 hours with a serial dilution of Fc AFNs. Average luciferase values (±STDEV) of triplicate measurements are plotted.

The HL116 clone is derived from the human HT1080 cell line (ATCC CCL-121). It contains the firefly luciferase gene controlled by the IFN-inducible 6-16 promoter. Vectors encoding human Clec4C or human CD8 were stably transfected in these HL116 cells, resulting in the HL116-hClec4C and HL116-hCD8 cell lines. To measure biological activity, parental and derived cells were seeded overnight at 20,000 cells per 96-well and subsequently stimulated with a serial dilution of Fc AFNs for 6 hours. Luciferase activity was measured in cell lysates. Data in FIG. 8 illustrate that mono-specific Fc AFNs are only active on the respective HL116-hClec4C and HL116-hCD8 cell lines, while the bi-specific Fc AFN induces signaling in both cell lines, but not in parental cells.

Example 5: Specific Stimulation of Human Clec4C Positive Cells by Targeted Cytokines In this Example, we compared signaling upon targeting of wild type IFNα2 or the AFN mutant IFNα2_R149A to a specific dendritic subset population within peripheral blood mononuclear cells (PBMCs). The cytokine, or mutant thereof, was targeted using a Clec4C VHH (clone 2CL92) in an Fc context.

Constructs:
Clec4C VHH-20*GGS-Fc3 (P-1571)
(SEQ ID NO: 1471)
QVQLQESGGGSVQAGDSLRLSCAASGRTFSGYAMGWFRQAPGKEREFVAT

ISTSGSSTYYADSVKGRFTISRDNAKKSVYLQINSLKTEDAAVYYCAARL

SFDNTAFYTSAIRYSYWGQGTQVTVSSGGSGGSGGSGGSGGSGGSGGSGG

SGGSGGSGGSGGSGGSGGSGGSGGSGGSGGSGGSDKTHTCPPCPAPE

AAGGPSVFLFPPKPKDTLMISRTPEVTCVVVDVSHEDPEVKFNWYVDGVEV

HNAKTKPREEQYNSTYRVVSVLTVLHQDWLNGKEYKCQVSNKALPAPIEK

TISKAKGQPREPQVCTLPPSRDELTKNQVSLSCAVKGFYPSDIAVEWESN

GQPENNYKTTPPVLDSDGSFFLVSKLTVDKSRWQQGNVFSCSVMHEALHN

HYTQKSLSLSPGK

-continued

Fc4-20*GGS-IFNa2_R149A (P-1414)
(SEQ ID NO: 1472)
DKTHTCPPCPAPEAAGGPSVFLFPPKPKDTLMISRTPEVTCVVVDVSHEDP

EVKFNWYVDGVEVHNAKTKPREEQYNSTYRVVSVLTVLHQDWLNGKEYKC

QVSNKALPAPIEKTISKAKGQPREPQVYTLPPCRDELTKNQVSLWCLVKG

FYPSDIAVEWESNGQPENNYKTTPPVLDSDGSFFLYSKLTVDKSRWQQGN

VFSCSVMHEALHNHYTQKSLSLSPGKGGSGGSGGSGGSGGSGGSGGSGGS

GGSGGSGGSGGSGGSGGSGGSGGSGGSGGSGGSGGSGGSCDLPQTHSLGSRRT

LMLLAQMRKISLFSCLKDRHDFGFPQEEFGNQFQKAETIPVLHEMIQQIF

NLFSTKDSSAAWDETLLDKFYTELYQQLNDLEACVIQGVGVEETPLMKED

SILAVRKYFQRITLYLKEKKYSPCAWEVVRAEIMASFSLSTNLQESLRSK

E

Fc4-20*GGS-IFNa2 (P-1538)
(SEQ ID NO: 1473)
DKTHTCPPCPAPEAAGGPSVFLFPPKPKDTLMISRTPEVTCVVVDVSHEDP

EVKFNWYVDGVEVHNAKTKPREEQYNSTYRVVSVLTVLHQDWLNGKEYKC

QVSNKALPAPIEKTISKAKGQPREPQVYTLPPCRDELTKNQVSLWCLVKG

FYPSDIAVEWESNGQPENNYKTTPPVLDSDGSFFLYSKLTVDKSRWQQGN

VFSCSVMHEALHNHYTQKSLSLSPGKGGSGGSGGSGGSGGSGGSGGSGGS

GGSGGSGGSGGSGGSGGSGGSGGSGGSGGSGGSGGSGGSCDLPQTHSLGSRRT

LMLLAQMRKISLFSCLKDRHDFGFPQEEFGNQFQKAETIPVLHEMIQQIF

NLFSTKDSSAAWDETLLDKFYTELYQQLNDLEACVIQGVGVEETPLMKED

SILAVRKYFQRITLYLKEKKYSPCAWEVVRAEIMRSFSLSTNLQESLRSK

E

Production and Purification of Clec4C VHH-Based IFN or AFN

Combinations of these constructs were transiently transfected in ExpiCHO cells and resulted in following AFNs (for a schematic outline of the construct, see FIG. 8(A)):
(i) Clec4C VHH-20*GGS-Fc3+Fc4-IFNα2_R149A
(ii) Clec4C VHH-20*GGS-Fc3+Fc4-IFNα2

One week after transfection, supernatant was collected, and cells removed by centrifugation. Recombinant proteins were purified from the supernatant using the Pierce Protein A spin plates (Thermo Fisher).

Biological Activity Upon Clec4C Targeting: STAT1 Phosphorylation in PBMCs

Figure 9:
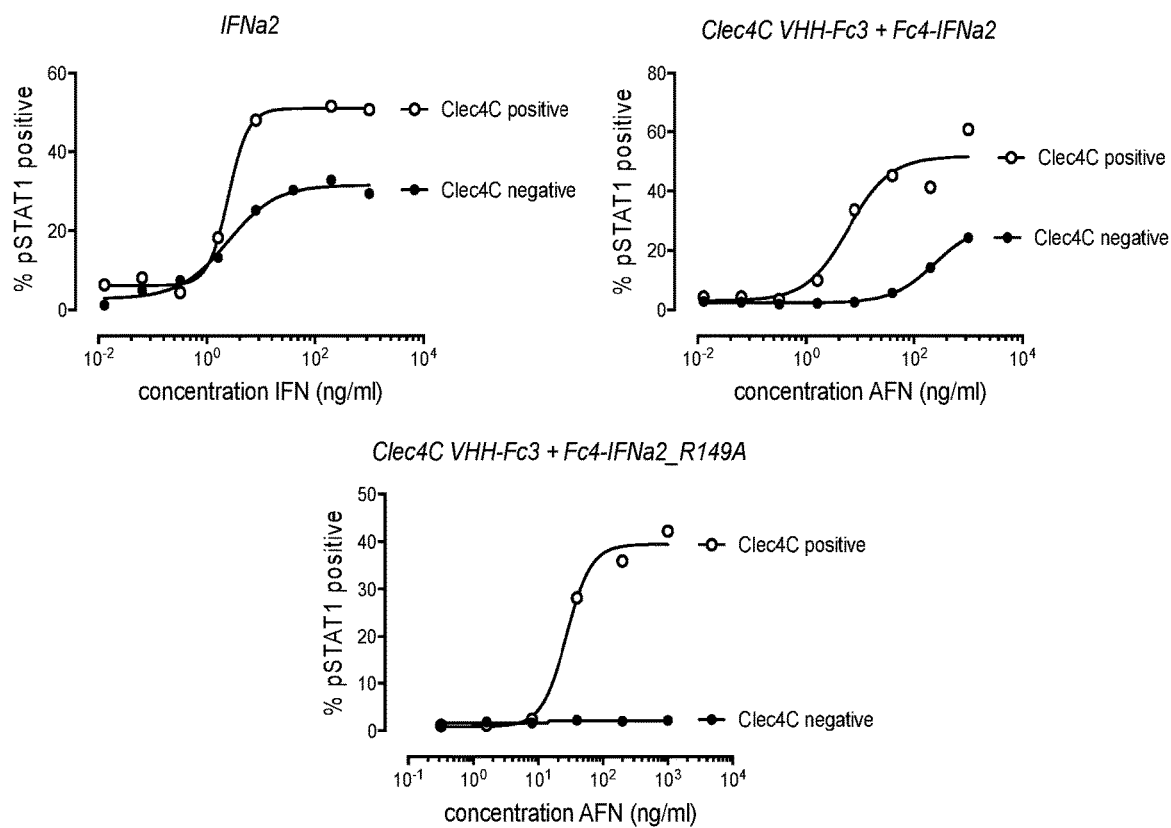
FIG. 9 shows biological activity of targeted wild type and mutant IFNa2 on C-Type Lectin Domain Family 4 Member C (Clec4C) positive and negative cells. Peripheral blood mononuclear cells (PBMC's) from healthy donors were stained with Clec4C Ab and stimulated with Clec4C-targeted wild type or mutant IFNa2 for 15 minutes. After fixation and permeabilization, cells were stained with a pSTAT1 Ab. Data are plotted as percentage of pSTAT1 positive cells.
Figure 10A:
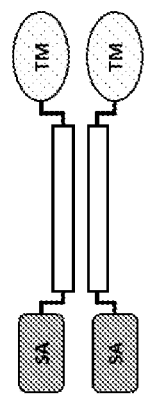
Figure 10B:
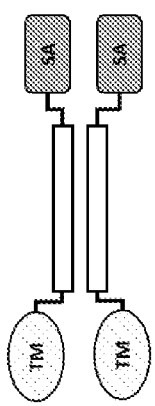
Figure 10C:
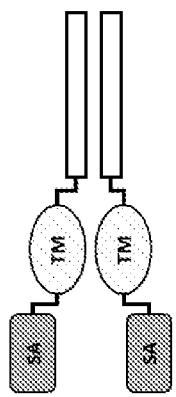
Figure 10D:
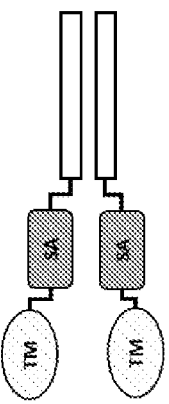
Figure 10E:
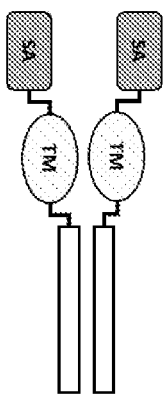
Figure 10F:
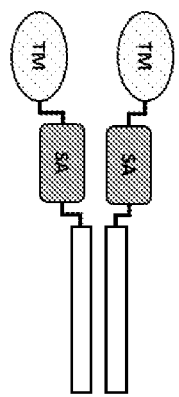
Figure 12E:
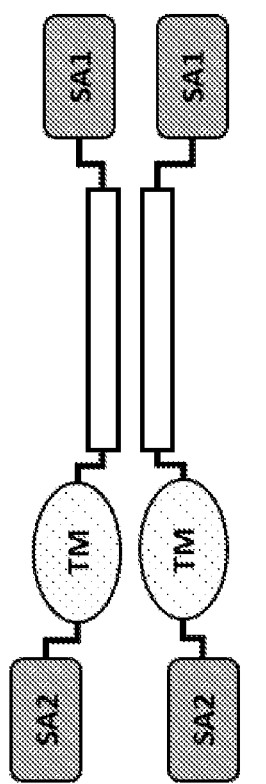
Figure 12F:
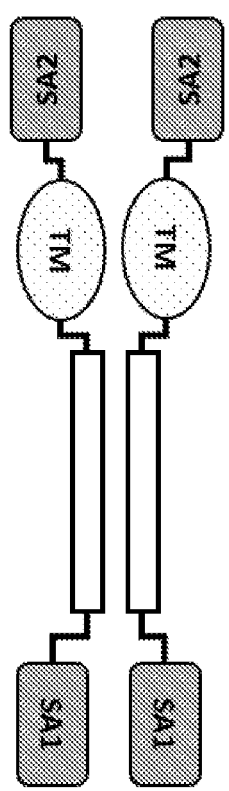
Figure 12G:
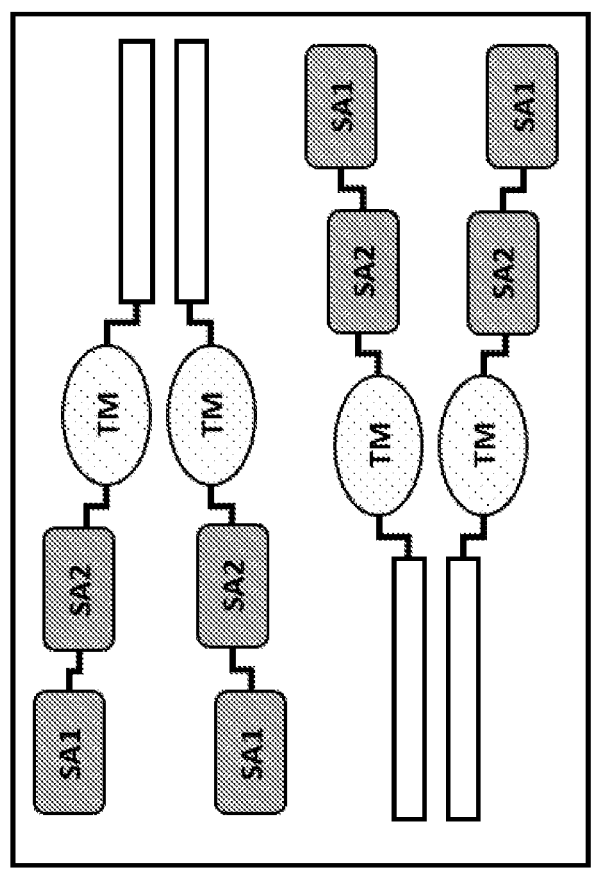
Figure 12H:
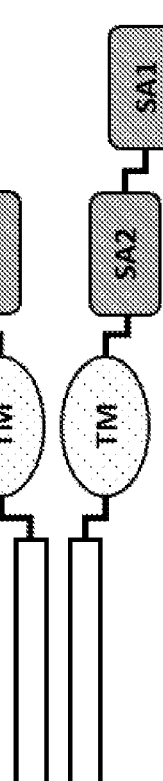
Figures 15A, 15B, 15C, 15D, 15E, 15F:
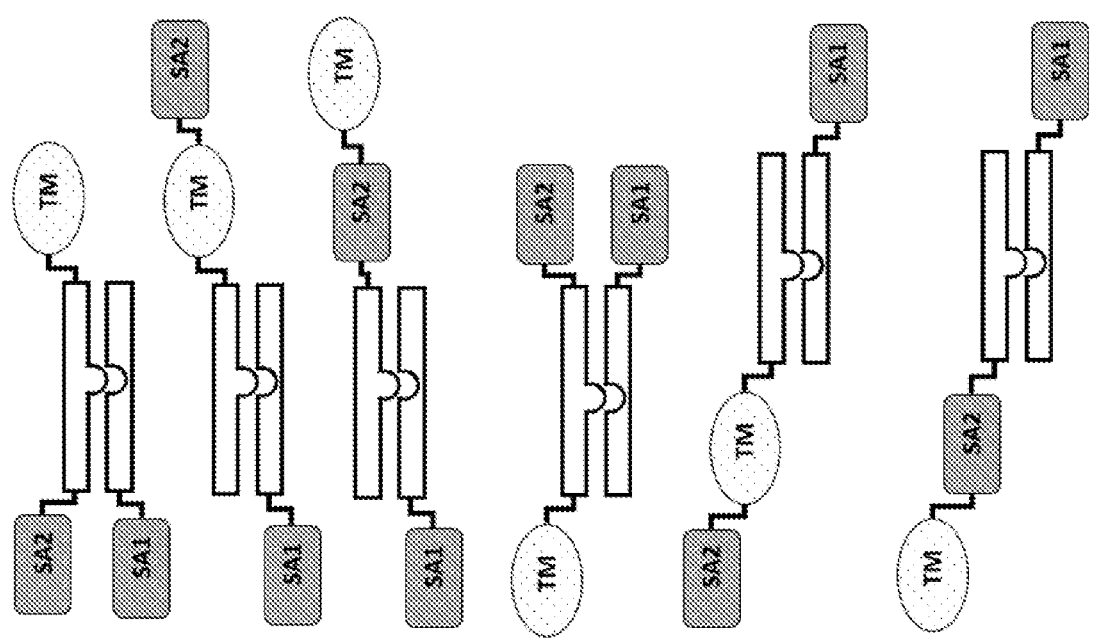
Figure 15G:
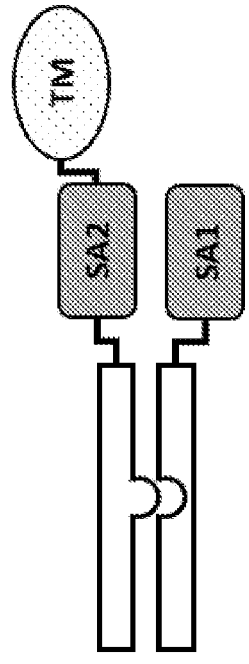
Figure 15H:
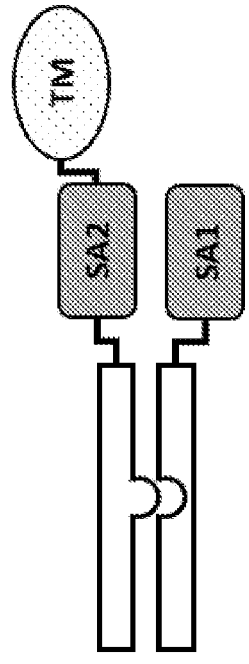
Figure 15I:
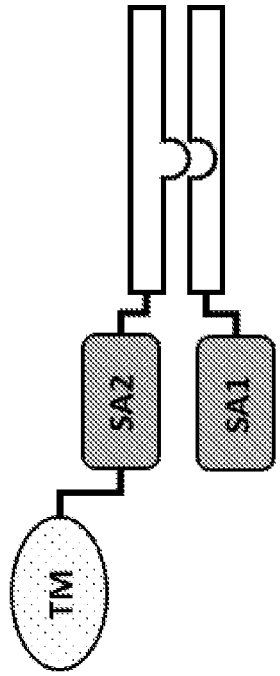
Figure 15J:
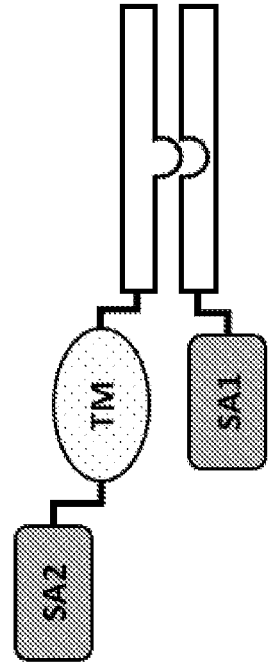

Biological activity of the Clec4C-targeted AFN was tested as follows: PBMCs from buffy coats of healthy donors were isolated using density gradient centrifugation with Ficoll-Paque (GE Healthcare). Dendritic cells were first enriched using the pan-DC enrichment kit (Miltenyi Biotec). Enriched cells were washed twice with FACS buffer (2% FBS, 1 mM EDTA in PBS) and stained with FITC-coupled anti-hClec4C (Miltenyi Biotec) for 20 minutes at 4° C. After two washes, cells were stimulated with a serial dilution of wild type or mutants Fc AFNs for 15 minutes at 37° C. After fixation (10 minutes, 37° C., Fix Buffer I; BD Biosciences) and permeabilization (30 minutes, on ice, Perm III Buffer I; BD Biosciences) and washing, cells were stained with anti-STAT1 pY701 Ab (BD Biosciences). Samples were acquired with a Macsquant X instrument (Miltenyi Biotec) and analysed using the FlowLogic software (Miltenyi Biotec). Data are summarized in FIG. 9. Clec4C positive and negative cells respond with similar potency (ratio of EC50s: ≈1) to wild type IFNa2. On the other hand, wild type or mutant IFNa2 is much more active when targeted with a Clec4C VHH to Clec4C positive cells. The respective EC50 ratios are about 40 and >40.

EQUIVALENTS

While the invention has been described in connection with specific embodiments thereof, it will be understood that it is capable of further modifications and this application is intended to cover any variations, uses, or adaptations of the invention following, in general, the principles of the invention and including such departures from the present disclosure as come within known or customary practice within the art to which the invention pertains and as may be applied to the essential features hereinbefore set forth and as follows in the scope of the appended claims.

Those skilled in the art will recognize, or be able to ascertain, using no more than routine experimentation, numerous equivalents to the specific embodiments described specifically herein. Such equivalents are intended to be encompassed in the scope of the following claims.

INCORPORATION BY REFERENCE

All patents and publications referenced herein are hereby incorporated by reference in their entireties.

The publications discussed herein are provided solely for their disclosure prior to the filing date of the present application. Nothing herein is to be construed as an admission that the present invention is not entitled to antedate such publication by virtue of prior invention.

As used herein, all headings are simply for organization and are not intended to limit the disclosure in any manner. The content of any individual section may be equally applicable to all sections.

TABLE 9

Illustrative Clec4C Binding Agent Sequences

| Clone | Protein Sequence | CDR1 AbM | CDR1 Kabat |
|---|---|---|---|
| 1CL21 | QVQLQESGGGLVRPGGSLRLSCVGSGSTFRHHAMAWFRQTT GKEREFVSAINDHGTKTRYSDSVRGRFTISRDNDENMVYLQMD NLRPEDTAVYSCAAGPLVDYLETVPVVYTYWGQGTQVTVSS (SEQ ID NO: 1400) | GSTFRHHAMA (SEQ ID NO: 1227) | HHAMA (SEQ ID NO: 1264) |
| 1CL25 | QVQLQESGGGLVQPGGSLRLSCAASGSTFRHHAMAWFRQTP GKEREFVSAINDHGDRTKYLDSVRGRFTISRDNTDNMVYLLMS DLRPEDTAVYSCAAGPLVDYLETTPLVYTYWGQGTQVTVSS (SEQ ID NO: 1401) | GSTFRHHAMA (SEQ ID NO: 1227) | HHAMA (SEQ ID NO: 1264) |

TABLE 9-continued

Illustrative Clec4C Binding Agent Sequences

| | | | |
|---|---|---|---|
| 1CL48 | QVQLQESGGGLVQPGGSLRLSCVGSGSTFRHHAMAWFRQTA GKEREFVSAINNHGTKTRYSDSVRGRFTISRDNDENMVYLQMD NLRPEDTAVYSCAAGPLVDYLETVPVVYTYWGQGTQVTVSS (SEQ ID NO: 1402) | GSTFRHHAMA (SEQ ID NO: 1227) | HHAMA (SEQ ID NO: 1264) |
| 1CL72 | QVQLQESGGGLVQPGESLKLSCAGSGSTFRHHAMAWFRQXP GKEREFVSAINDHGDRTKYLDSVRGRFTISRDNTNNMVYLQMS DLRPEDTANYSCAAGPLVDYLETTPLVYTYWGQGTQVTVSS (SEQ ID NO: 1403) | GSTFRHHAMA (SEQ ID NO: 1227) | HHAMA (SEQ ID NO: 1264) |
| 2CL4 | QVQLQESGGGLVQPGGSLRISCAGSGSTFRHHAMAWFRQTA GKEREFVSAINDHGTKTRYSDSVRGRFTISRDNDENMVYLQMD NLRSEDTANYTCAAGPLVDYLETVPVVYTYWGQGTQVTVSS (SEQ ID NO: 1404) | GSTFRHHAMA (SEQ ID NO: 1227) | HHAMA (SEQ ID NO: 1264) |
| 2CL8 | QVQLQESGGGLVQPGGSLKLSCAGSGSTFRHHALAWFRQTAE KEREFVSAINDHGTKTRYSDSVRGRFTISRDNDGNMVYLQMDN LRPEDTAVYSCAAGPLVDYLETVPVVYTYWGQGTQVTVSS (SEQ ID NO: 1405) | GSTFRHHALA (SEQ ID NO: 1228) | HHALA (SEQ ID NO: 1265) |
| 2CL41 | QVQLQESGGGLVQPGGSLRLSCAASGSTFRHHAMAWFRQTP GKEREFVSAINDHGDRTKYLDSVRGRFTISRDNTDNMVYLQMS DLRTEDTAVYTCAAGPLVDYLETTPLVYTYWGQGTQVTVSS (SEQ ID NO: 1406) | GSTFRHHAMA (SEQ ID NO: 1227) | HHAMA (SEQ ID NO: 1264) |
| 2CL72 | QVQLQESGGGLVQPGGSLKLSCAASGSTFRHHAMAWFRQTP GKEREFVSAINDHGDRTKYLDSVRGRFTISRDNTDNMVYLQMS DLRPEDTAVYSCAAGPLVDYLETTPLVYTYWGQGTQVTVSS (SEQ ID NO: 1407) | GSTFRHHAMA (SEQ ID NO: 1227) | HHAMA (SEQ ID NO: 1264) |
| 2CL78 | QVQLQESGGGWQPGGSLKLSCAASGSTFRHHAMAWFRQTP GKEREFVSAINDHGDRTKYLDSVRGRFTISRDDTDNMVYLQMS DLRTEDTAVYTCAAGPLVDYLETTPLVYTYWGQGTQVTVSS (SEQ ID NO: 1408) | GSTFRHHAMA (SEQ ID NO: 1227) | HHAMA (SEQ ID NO: 1264) |
| 2CL87 | QVQLQESGGGLVQPGGSLRLSCAGSGSTFRHHAMAWFRQTP GKEREFVSAINDHGDRTKYTDSVRGRFTISRDNTDNMVYLQMS DLRPEDTAVYSCAAGPLVDYLETTPLVYTYWGQGTQVTVSS (SEQ ID NO: 1409) | GSTFRHHAMA (SEQ ID NO: 1227) | HHAMA (SEQ ID NO: 1264) |
| 2CL88 | QVQLQESGGGLVQPGGSLKLSCTGSGSTFRHHAMAWFRQTP GKEREFVAAINDHGDRTKYLDSVRGRFTISRDNTDNMVYLQMS DLRPEDTANYSCAAGPLVDYLETTPLVYTYWGQGTQVTVSS (SEQ ID NO: 1410) | GSTFRHHAMA (SEQ ID NO: 1227) | HHAMA (SEQ ID NO: 1264) |
| 2CL90 | QVQLQESGGGLVQPGGSLRLSCAASGSTFRHHAMAWFRQTP GKGREFVSAINDHGDRTKYLDSVRGRFTISRDNTDNMVYLQMS DLRPEDTAVYSCAAGPLVDYLETTPLVYTYWGQGTQVTVSS (SEQ ID NO: 1411) | GSTFRHHAMA (SEQ ID NO: 1227) | HHAMA (SEQ ID NO: 1264) |
| 2CL95 | QVQLQESGGGLVQPGGSLKLSCAGSGSTFKHHAMAWFRHTP GKEREFVSAINDHGDRTKYSDSVRGRFTIARDNTDNMVYLQMD DLLPEDTANYTCAAGPLVDYLETTPLVYTYWGQGTQVTVSS (SEQ ID NO: 1412) | GSTFKHHAMA (SEQ ID NO: 1229) | HHAMA (SEQ ID NO: 1264) |
| 1CL54 | QVQLQESGGGLAQAGASLRLSCAGSGNNFEHYAVAWFRQDA PGKERDFVAAIRDYGDRTRYDDSVKGRFTISRDNAKSMVYLEM NNLKPKDAAVYYCAAGPLNDYLEVTPLVYTYWGQGTQVTVSS (SEQ ID NO: 1413) | GNNFEHYAVA (SEQ ID NO: 1230) | HYAVA (SEQ ID NO: 1266) |
| 2CL52 | QVQLQESGGGLAQAGASLRLSCAGSGNNFEHYAVAWFRQEA PGKERDFVAAIRDYGDRTRYADSVKGRFTISRDNAKSMVYLEM NNLKPEDTAVYYCTAGPLNDYLEVTPLVYTYWGQGTQVTVSS (SEQ ID NO: 1414) | GNNFEHYAVA (SEQ ID NO: 1230) | HYAVA (SEQ ID NO: 1266) |
| 1CL2 | QVQLQESGGGLVQAGDSLRLSCAASGDTFSMYAMGWFRQAP GKEREFVAAISRSGGSTDYRDSVKGRFTISRDNDLNAGYLQMN SLKPEDTAVYYCALRIFSTTTAYTGELQYPYWGQGTQVIVSS (SEQ ID NO: 1415) | GDTFSMYAMG (SEQ ID NO: 1231) | MYAMG (SEQ ID NO: 1267) |
| 1CL32 | QVQLQESGGGLVQAGDSLRLSCAASGDTFSMYTMGWFRQAP GKEREFVAAISRSGGSTNYRDSVKGRFTISRDNDLNAGYLQMN SLKPEDTAVYYCALRLIFSTTTAYTGELQYPYWGQGTQVIVSS (SEQ ID NO: 1416) | GDTFSMYTMG (SEQ ID NO: 1232) | MYTMG (SEQ ID NO: 1268) |

TABLE 9-continued

Illustrative Clec4C Binding Agent Sequences

| | | | |
|---|---|---|---|
| 2CL58 | QVQLQESGGGLVQAGDSLRLSCAASGDTFSMYAMGWFRQAP GKEREFVAAISRSGSSTNYRDSVKGRFTISRDNDLNAGYLQMN SLKPEDTAVYYCALRLTFSTTTTYTGELQYPYWGQGTQVTVSS (SEQ ID NO: 1417) | GDTFSMYAMG (SEQ ID NO: 1231) | MYAMG (SEQ ID NO: 1267) |
| 2CL73 | QVQLQESGGGLVQAGDSLRLSCAASGNTFSMYAMGWFRQAP GKEREFVAAISRSGGSTNYRDSVKGRFTISRDNDLNAGYLQMN NLKPEDTAVYYCALRLIFSTTDAYTGKLQYPYWGQGTQVIVSS (SEQ ID NO: 1418) | GNTFSMYAMG (SEQ ID NO: 1233) | MYAMG (SEQ ID NO: 1267) |
| 2CL43 | QVQLQESGGGTVQPGESLRLSCEVSTDTFSSLAMAWFRQATG KDREFVAAISWSGASTVYGDSVKGRFTMTRDHPKKMVYLQMD NLKPEDTAVYYCAGDLDGRTWHGDDLEYDYWGQGTQVTVSS (SEQ ID NO: 1419) | TDTFSSLAMA (SEQ ID NO: 1234) | SLAMA (SEQ ID NO: 1269) |
| 2CL82 | QVQLQESGGGLVQPGSSLRLSCEVSTDTFSSLAMAWFRQATG KEREFVAAISWSGASTVYGDSVKGRFTMTRDHPKKMVYLQMD NLKPEDTAVYYCAGDLDGRTWHGDDLEYDYWGQGTQVTVSS (SEQ ID NO: 1420) | TDTFSSLAMA (SEQ ID NO: 1234) | SLAMA (SEQ ID NO: 1269) |
| 2CL89 | QVQLQESGGGTVQPGESLRLSCEVSTDTFSSLAMAWFRQATA KDREFVAAISWSGDSTVYGDSVKGRFTMTRDHPKKMVYLQMD NLKPEDTAVYYCAGDLDGRTWHGDDLEYDYWGQGTQVTVSS (SEQ ID NO: 1421) | TDTFSSLAMA (SEQ ID NO: 1234) | SLAMA (SEQ ID NO: 1269) |
| 2CL25 | QVQLQESGGGSVQAGGSLRLSCAASGRTFSNYAMGXFRQTP GKEREFVATISVSGSSTDYADSVKGRFTISRDNAKKTVYLQIN SLKTEDTAVYYCAARLSFDNTALYTSANRYSYWGQGTQVTVSS (SEQ ID NO: 1422) | GRTFSNYAMG (SEQ ID NO: 1235) | NYAMG (SEQ ID NO: 1270) |
| 2CL84 | QVQLQESGGGSVQAGGSLRLSCAASGRTFSDYAMGWFRQAP GKEREFVATISKSGSSTDYADSAKGRFTISRDNAKKTVYLQIN SLKTEDTAVYYCAARLSFDNTAFYTSAIRYSDWGQGTQVTVSS (SEQ ID NO: 1423) | GRTFSDYAMG (SEQ ID NO: 1236) | DYAMG (SEQ ID NO: 1271) |
| 2CL92 | QVQLQESGGGSVQAGDSLRLSCAASGRTFSGYAMGWFRQAP GKEREFVATISTSGSSTYYADSVKGRFTISRDNAKKSVYLQI NSLKTEDAAVYYCAARLSFDNTAFYTSAIRYSYWGQGTQVTV SS (SEQ ID NO: 1424) | GRTFSGYAMG (SEQ ID NO: 1237) | GYAMG (SEQ ID NO: 1272) |
| 2CL21 | QVQLQESGGGLVQAGGSLRLSCAASGRTFTGYAMGWFRQVP GLEREFVARISRSGNSTGYADSVKGRFTVSRDNAKSTMYLQM NSLKTEDTAVYYCAATTSWLPGHNANVYDYWGQGTQVTVSS (SEQ ID NO: 1425) | GRTFTGYAMG (SEQ ID NO: 1238) | GYAMG (SEQ ID NO: 1272) |
| 2CL30 | QVQLQESGGGSVQAGGSLRLSCAASGRTFSDYAMGWFRQVP GLEREFVARISRSGDSTGYADSVKGRFTVSRDNAKNTVYLQMN SLKTEDTAVYYCAATTSWLPGHNANVYDYWGQGTQVTVSS (SEQ ID NO: 1426) | GRTFSDYAMG (SEQ ID NO: 1236) | DYAMG (SEQ ID NO: 1271) |
| 2CL71 | QVQLQESGGGLVQAGGSLRLSCAASGLTFGRYAMGWFRQVP GLEREFIARISRSGDNTGYADSVKGRFTVSRDSAKSTVYLQMN SLKTEDTAVYYCAAGTSVVVPGHNANAYDYWGQGTQVTVSS (SEQ ID NO: 1427) | GLTFGRYAMG (SEQ ID NO: 1239) | RYAMG (SEQ ID NO: 1273) |
| 2CL7 | QVQLQESGGGLVQAGDSLRLSCAPSGFTFDGYAIGWFRQAPG KEREKVACINKSDGLTYYEDSVKGRFTISSDTAKNTIHLQMNS LKPDDTAVYYCAAAWECDYAPADFGSWGQGTQVTVSS (SEQ ID NO: 1428) | GLTFGRYAMG (SEQ ID NO: 1239) | RYAMG (SEQ ID NO: 1273) |
| 2CL18 | QVQLQESGGGLVQAGGSLRLSCAPSGFTFDGYAIGWFRQAPG KEREKVACINKSDGLTYYEDSVKGRFTISSDTAKNTIHLQMN SLKPDDTAVYYCAAAWECDYAPADFGSWGQGTQVTVSS (SEQ ID NO: 1429) | GFTFDGYAIG (SEQ ID NO: 1240) | GYAIG (SEQ ID NO: 1274) |
| 2CL26 | QVQLQESGGGVVVQPGDSLRLSCAASGFTFSDYAVGWFRQAP GKEREFVARITRLGNGPYYSASVKGRFTISRDNARDMAYLKMD ALTPEDTATYYCAAGRTLASTHDTKTSPQTYDYWGLGTQVTVS S (SEQ ID NO: 1430) | GFTFSDYAVG (SEQ ID NO: 1241) | DYAVG (SEQ ID NO: 1275) |
| 2CL55 | QVQLQESGGGVVVQPGDSLRLSCAASGSTFSDYAVGWFRQAP GKEREFVARITRLGNGPYYSASVKGRFTISRDNARDMAYLKMD ALTPEDTATYYCAAGRTLASTHDTKTSPQTYDYWGQGTQVTV SS (SEQ ID NO: 1431) | GSTFSDYAVG (SEQ ID NO: 1242) | DYAVG (SEQ ID NO: 1275) |

TABLE 9-continued

Illustrative Clec4C Binding Agent Sequences

| | | | |
|---|---|---|---|
| 1CL47 | QVQLQESGGGLVQAGGSRRLSCAASGRTFINYAMGWFRQAP GKEREFVAAISTSGSNTYLADSLKARFTISRDNAKNTVYLQIR SLNPEDTAVYYCAARLSFDDSAYYTSTLRYAYWGQGTQVTVSS (SEQ ID NO: 1432) | GRTFINYAMG (SEQ ID NO: 1243) | NYAMG (SEQ ID NO: 1270) |
| 2CL59 | QVQLQESGGGLVQPGDSLTLSCADSGRTFSNYAMGWFHQAP GKEREFVAAISTSGGSTAYADSVKGRFTISRDNAKNTVYLQMN NLKPEDTAVYYCAARLSFSGSSYYQGPLQYPYWGQGTQVTVS S (SEQ ID NO: 1433) | GRTFSNYAMG (SEQ ID NO: 1235) | NYAMG (SEQ ID NO: 1270) |
| 2CL16 | QVQLQESGGGLVQPGGSLRLSCAASGDTFSNYAMGWFRQAP GKAREFVAAISRSAGSTYHVDSVKGRFTISRDNAMNTVYLQMN SLQPEDTAHYYCAARLTFNLIDYYTAETRYTYWGQGTQVTVSS (SEQ ID NO: 1434) | GDTFSNYAMG (SEQ ID NO: 1245) | NYAMG (SEQ ID NO: 1270) |
| 2CL91 | QVQLQESGGGLVQAGDSLRLSCTASERTFSNYAMGWFRLAPG KERKFVAAISTSGGTTDYVDSVKGRFTISRDNAKNTVYLQMNSL KPEDTAVYYCAARLDFSSTDLYTTAPRYPYWGQGTQVTVSS (SEQ ID NO: 1435) | ERTFSNYAMG (SEQ ID NO: 1246) | NYAMG (SEQ ID NO: 1270) |
| 2CL15 | QVQLQESGGGLVQPGGSVRLSCAASVFTLNNFIMSVVVRQAPG KGLERVSDINMVGITDYSDPVKGRFTISRDNKQNTVYLQGNTLK PEDTAVYFCAAGRPIGLYYPSPRIRDYNDWGQGTQVTVSS (SEQ ID NO: 1436) | VFTLNNFIMS (SEQ ID NO: 1247) | NFIMS (SEQ ID NO: 1276) |
| 2CL81 | QVQLQESGGGLVQAGDSLKLSCAASGRTFSTYAMGWFRQAP GKERDWAAIATNGGTTYYVDSVKGRFTISRDNAQNRVYLQMN SLKPEDTAIYYCAARLSFGSGYYTNKLNYAYWGQGTQVTVSS (SEQ ID NO: 1437) | GRTFSTYAMG (SEQ ID NO: 1248) | TYAMG (SEQ ID NO: 1277) |
| 1CL81 | QVQLQESGGGLVQAGNSLKLSCAASGRNLAYYVMGWFRQAP GREREPVATLTRGGDDTYCADSVKGRFTISSDNAKNTVYLQMN NLKPEDTAIYTCAARLAVLSSNTYCSGLWDYWGQGTQVTVSS (SEQ ID NO: 1438) | GRNLAYYVMG (SEQ ID NO: 1249) | YYVMG (SEQ ID NO: 1278) |
| 1CL56 | QVQLQESGGGLVQPGGSLTLSCGASGFDFSDYVMYWLRQAP GKGLQVVVSSINASGVRTYYVDALKGRFTISRDNAKNTLYLQI DDLKPEDTGLYYCARVGQAPMYFGVDFWGNGTQVTVSS (SEQ ID NO: 1439) | GFDFSDYVMY (SEQ ID NO: 1250) | DYVMY (SEQ ID NO: 1279) |
| 2CL40 | QVQLQESGGGLVQTGGSLRVSCAASGRSISNYNMGWFRQPP GKEREIVGSIRWDGDSTYYADSVKGRFTISRDNTKNTVYLQMN SLKSEDTADYYCAATVSSFDESKNPRVVYPYWGQGTQVTVSS (SEQ ID NO: 1440) | GRSISNYNMG (SEQ ID NO: 1251) | NYNMG (SEQ ID NO: 1280) |
| 2CL65 | QVQLQESGGGLVQPGGSLRLSCAASGRIFSINAMGVVYRQAPG KQRELVAVISRSGISNYVDSVKGRFTISRDNAKNTVYLQMNSLN PEDTADYYCNADVLLTFNKREDSWGQGTQVTVSS (SEQ ID NO: 1441) | GRIFSINAMG (SEQ ID NO: 1252) | INAMG (SEQ ID NO: 1281) |
| 2CL57 | QVQLQESGGGLVQAGGSLKLSCAASGRTFSSYAMGWFRQAP GKERDFVAVISWRNNTYYADSVKGRFTISRDNAKNTVHLQMNS LKSEDTAVYYCAAAGLGAWAGMSDYDYWGQGTQVTVSS (SEQ ID NO: 1442) | GRTFSSYAMG (SEQ ID NO: 1253) | SYAMG (SEQ ID NO: 1282) |
| 2CL56 | QVQLQESGGGSVQAGDSLTLSCIASGRTFSSLAMGWFRQAPG KEREFVAAINWSGDSTYYSDSMKGRLTMSRDNAKNTVFLQMN SLEPEDTAVYVCAADASGYGSAWPDRYDYWGQGTQVTVSS (SEQ ID NO: 1443) | GRTFSSLAMG (SEQ ID NO: 1254) | SLAMG (SEQ ID NO: 1283) |
| 2CL66 | QVQLQESGGGLVQAGGSLRLSCAASERTFTNYAMGWFRQGP GKDRAFVAAISRSGSSTSYADSVKGRFTISRDNAENILYLQMNS LKPEDTAVYYCAAAPLVLKTTPGAYNYWGQGTQVTVSS (SEQ ID NO: 1444) | ERTFTNYAMG (SEQ ID NO: 1255) | NYAMG (SEQ ID NO: 1270) |
| 2CL34 | QVQLQESGGGLVQAGGSLRLSCAASGRTFTNYAMGWFRQAP GKEREFVATISRSGSMPYYADSVKGRFTISRDNAKNMVYLQMN SLKPEDTAVYYCAANVLVTTTRLDQYDSWGQGTQVTVSS (SEQ ID NO: 1445) | GRTFTNYAMG (SEQ ID NO: 1256) | NYAMG (SEQ ID NO: 1270) |
| 2CL46 | QVQLQESGGGLVQAGGSLRLSCAVSGRTFSSYAMGWFRQAR GKEREFVAAVEWSSGSTFYTDSVKGRFAISRDIAKNTVYLQMN SLKPEDTAVYYCAGDHTGKLVFSKTSDYWGQGTQVTVSS (SEQ ID NO: 1446) | GRTFSSYAMG (SEQ ID NO: 1253) | SYAMG (SEQ ID NO: 1282) |

TABLE 9-continued

Illustrative Clec4C Binding Agent Sequences

| 2CL29 | QVQLQESGGGLVQPGDSLRLSCTASERTFTNYAMAWFRQAP GKERDVLATISRSGSSTFYAESVKGRFTISRDNTKNTVYLQMNS LEPEDTAVYYCAARPLVPSEDPDNYNYWGQGTQVTVSS (SEQ ID NO: 1447) | ERTFTNYAMA (SEQ ID NO: 1257) | NYAMA (SEQ ID NO: 1284) |
| --- | --- | --- | --- |
| 1CL88 | QVQLQESGGGLVQAGGSLRLSCAASGRIFSNSAMGWFRQVLG KEREFVAAISENSSILYYTASVKGRFTISRDNDKNTVYLQMTS LKAEDTAVYYCAGYGSTTIRTTTRPTKWGQGTQVTVSS (SEQ ID NO: 1448) | GRIFSNSAMG (SEQ ID NO: 1258) | NSAMG (SEQ ID NO: 1285) |
| 2CL68 | QVQLQESGGGLVQAGDSLRLSCVASGRTLSNYGMGWFRQAP GKGREFVAYISRTGGSTKYENSVKGRFIISRDTAKNTIYLQMNS LQGEDTAVYYCAFHYNGVYQDSQSYDYWGXGTQVTVSS (SEQ ID NO: 1449) | GDTFSMYAMG (SEQ ID NO: 1231) | MYAMG (SEQ ID NO: 1267) |
| 1CL82 | QVQLQESGGGSVQAGDSLRLSCVAPGREISSPAMGWFRQAP GKEREFVATINWSSGATLTADSVKGRFTIFKDVEKNTVYLQMN SLRPEDTAVYSCAAGATGVFRIARAYSYWGQGTQVTVSS (SEQ ID NO: 1450) | GREISSPAMG (SEQ ID NO: 1259) | SPAMG (SEQ ID NO: 1286) |
| 2CL49 | QVQLQESGGGLMQAGDSLRLSCTVSGRDFANDAVAWFRXPP GKEREFVVGIGSNNGTLTADSVKGRSTIWRDNIKNTVYLQMSR LTPDDTAVYYCASGPTFFRIARAYPYWGQGTQVTVSS (SEQ ID NO: 1451) | GRDFANDAVA (SEQ ID NO: 1260) | NDAVA (SEQ ID NO: 1287) |
| 1CL72 revised | QVQLQESGGGLVQPGESLKLSCAGSGSTFRHHAMAWFRQTP GKEREFVSAINDHGDRTKYLDSVRGRFTISRDNTNNMVYLQMS DLRPEDTANYSCAAGPLVDYLETTPLVYTYWGQGTQVTVSS (SEQ ID NO: 1452) | GSTFRHHAMA (SEQ ID NO: 1227) | HHAMA (SEQ ID NO: 1264) |
| 2CL25 revised | QVQLQESGGGSVQAGGSLRLSCAASGRTFSNYAMGWFRQTP GKEREFVATISVSGSSTDYADSVKGRFTISRDNAKKTVYLQINS LKTEDTAVYYCAARLSFDNTALYTSANRYSYWGQGTQVTVSS (SEQ ID NO: 1453) | GRTFSNYAMG (SEQ ID NO: 1235) | NYAMG (SEQ ID NO: 1270) |
| 2CL68 revised | QVQLQESGGGLVQAGDSLRLSCVASGRTLSNYGMGWFRQAP GKGREFVAYISRTGGSTKYENSVKGRFIISRDTAKNTIYLQMN SLQGEDTAVYYCAFHYNGVYQDSQSYDYWGQGTQVTVSS (SEQ ID NO: 1454) | GDTFSMYAMG (SEQ ID NO: 1231) | MYAMG (SEQ ID NO: 1267) |
| 2CL49 revised | QVQLQESGGGLMQAGDSLRLSCTVSGRDFANDAVAWFRQPP GKEREFVVGIGSNNGTLTADSVKGRSTIWRDNIKNTVYLQMSR LTPDDTAVYYCASGPTFFRIARAYPYWGQGTQVTVSS (SEQ ID NO: 1455) | GRDFANDAVA (SEQ ID NO: 1260) | NDAVA (SEQ ID NO: 1287) |

| Clone | CDR2 AbM | CDR2 Kabat | CDR3 |
| --- | --- | --- | --- |
| 1CL21 | AIN DHGTKTR (SEQ ID NO: 1289) | AINDHGTKTRYSDSVRG (SEQ ID NO: 1326) | GPLVDYLETV PVVYTY (SEQ ID NO: 1366) |
| 1CL25 | AINDHGDRTK (SEQ ID NO: 1290) | AINDHGDRTKYLDSVRG (SEQ ID NO: 1327) | GPLVDYLETT PLVYTY (SEQ ID NO: 1367) |
| 1CL48 | AIN NHGTKTR (SEQ ID NO: 1291) | AINNHGTKTRYSDSVRG (SEQ ID NO: 1328) | GPLVDYLETV PVVYTY (SEQ ID NO: 1366) |
| 1CL72 | AINDHGDRTK AINDHGDRTK (SEQ ID NO: 1290) | AINDHGDRTKYLDSVRG (SEQ ID NO: 1327) | GPLVDYLETT PLVYTY (SEQ ID NO: 1367) |
| 2CL4 | AINDHGTKTR (SEQ ID NO: 1289) | AINDHGTKTRYSDSVRG (SEQ ID NO: 1326) | GPLVDYLETV PVVYTY (SEQ ID NO: 1366) |
| 2CL8 | AIN DHGTKTR (SEQ ID NO: 1289) | AINDHGTKTRYSDSVRG (SEQ ID NO: 1326) | GPLVDYLETV PVVYTY (SEQ ID NO: 1366) |
| 2CL41 | AINDHGDRTK (SEQ ID NO: 1290) | AINDHGDRTKYLDSVRG (SEQ ID NO: 1327) | GPLVDYLETT PLVYTY (SEQ ID NO: 1367) |

TABLE 9-continued

Illustrative Clec4C Binding Agent Sequences

| | | | |
|---|---|---|---|
| 2CL72 | AINDHGDRTK (SEQ ID NO: 1290) | AINDHGDRTKYLDSVRG (SEQ ID NO: 1327) | GPLVDYLETT PLVYTY (SEQ ID NO: 1367) |
| 2CL78 | AINDHGDRTK (SEQ ID NO: 1290) | AINDHGDRTKYLDSVRG (SEQ ID NO: 1327) | GPLVDYLETT PLVYTY (SEQ ID NO: 1367) |
| 2CL87 | AINDHGDRTK (SEQ ID NO: 1290) | AINDHGDRTKYTDSVRG (SEQ ID NO: 1329) | GPLVDYLETT PLVYTY (SEQ ID NO: 1367) |
| 2CL88 | AINDHGDRTK (SEQ ID NO: 1290) | AINDHGDRTKYLDSVRG (SEQ ID NO: 1327) | GPLVDYLETT PLVYTY (SEQ ID NO: 1367) |
| 2CL90 | AINDHGDRTK (SEQ ID NO: 1290) | AINDHGDRTKYLDSVRG (SEQ ID NO: 1327) | GPLVDYLETT PLVYTY (SEQ ID NO: 1367) |
| 2CL95 | AINDHGDRTK (SEQ ID NO: 1290) | AINDHGDRTKYSDSVRG (SEQ ID NO: 1330) | GPLVDYLETT PLVYTY (SEQ ID NO: 1367) |
| 1CL54 | AIRDYGDRTR (SEQ ID NO: 1292) | AIRDYGDRTRYDDSVKG (SEQ ID NO: 1331) | GPLNDYLEVT PLVYTY (SEQ ID NO: 1368) |
| 2CL52 | AIRDYGDRTR (SEQ ID NO: 1292) | AIRDYGDRTRYADSVKG (SEQ ID NO: 1332) | GPLNDYLEVT PLVYTY (SEQ ID NO: 1368) |
| 1CL2 | AISRSGGSTD (SEQ ID NO: 1293) | AISRSGGSTDYRDSVKG (SEQ ID NO: 1333) | RLTFSTTTAY TGELQYPY (SEQ ID NO: 1369) |
| 1CL32 | AISRSGGSTN (SEQ ID NO: 1294) | AISRSGGSTNYRDSVKG (SEQ ID NO: 1334) | RLTFSTTTAY TGELQYPY (SEQ ID NO: 1369) |
| 2CL58 | AISRSGSSTN (SEQ ID NO: 1295) | AISRSGSSTNYRDSVKG (SEQ ID NO: 1335) | RLTFSTTTTY TGELQYPY (SEQ ID NO: 1370) |
| 2CL73 | AISRSGGSTN (SEQ ID NO: 1294) | AISRSGGSTNYRDSVKG (SEQ ID NO: 1334) | RLTFSTTDAY TGKLQYPY (SEQ ID NO: 1371) |
| 2CL43 | AISWSGASTV (SEQ ID NO: 1296) | AISWSGASTVYGDSVKG (SEQ ID NO: 1336) | DLDGRTWHG DDLEYDY (SEQ ID NO: 1372) |
| 2CL82 | AISWSGASTV (SEQ ID NO: 1296) | AISWSGASTVYGDSVKG (SEQ ID NO: 1336) | DLDGRTWHG DDLEYDY (SEQ ID NO: 1372) |
| 2CL89 | AISWSGDSTV (SEQ ID NO: 1297) | AISWSGDSTVYGDSVKG (SEQ ID NO: 1337) | DLDGRTWHG DDLEYDY (SEQ ID NO: 1372) |
| 2CL25 | TISVSGSSTD (SEQ ID NO: 1298) | TISVSGSSTDYADSVKG (SEQ ID NO: 1338) | RLSFDNTALY TSANRYSY (SEQ ID NO: 1373) |
| 2CL84 | TISKSGSSTD (SEQ ID NO: 1299) | TISKSGSSTDYADSAKG (SEQ ID NO: 1339) | RLSFDNTAFY TSAIRYSD (SEQ ID NO: 1374) |

TABLE 9-continued

Illustrative Clec4C Binding Agent Sequences

| | | | |
|---|---|---|---|
| 2CL92 | TISTSGSSTY (SEQ ID NO: 1300) | TISTSGSSTYYADSVKG (SEQ ID NO: 1340) | RLSFDNTAFY TSAIRYSY (SEQ ID NO: 1375) |
| 2C21 | RISRSGNSTG (SEQ ID NO: 1301) | RISRSGNSTGYADSVKG (SEQ ID NO: 1341) | TTSWLPGHN ANVYDY (SEQ ID NO: 1376) |
| 2CL30 | RISRSGDSTG (SEQ ID NO: 1302) | RISRSGDSTGYADSVKG (SEQ ID NO: 1342) | TTSWLPGHN ANVYDY (SEQ ID NO: 1376) |
| 2CL71 | RISRSGDNTG (SEQ ID NO: 1303) | RISRSGDNTGYADSVKG (SEQ ID NO: 1343) | GTSVVVPGHN ANAYDY (SEQ ID NO: 1377) |
| 2CL7 | CINKSDGLTY (SEQ ID NO: 1304) | CINKSDGLTYYEDSVKG (SEQ ID NO: 1344) | AWECDYAPA DFGS (SEQ ID NO: 1378) |
| 2CL18 | CINKSDGLTY (SEQ ID NO: 1304) | CINKSDGLTYYEDSVKG (SEQ ID NO: 1344) | AWECDYAPA DFGS (SEQ ID NO: 1378) |
| 2CL26 | RITRLGNGPY (SEQ ID NO: 1305) | RITRLGNGPYYSASVKG (SEQ ID NO: 1345) | GRTLASTHDT KTSPQTYDY (SEQ ID NO: 1379) |
| 2CL55 | RITRLGNGPY (SEQ ID NO: 1305) | RITRLGNGPYYSASVKG (SEQ ID NO: 1345) | GRTLASTHDT KTSPQTYDY (SEQ ID NO: 1379) |
| 1CL47 | AISTSGSNTY (SEQ ID NO: 1306) | AISTSGSNTYLADSLKA (SEQ ID NO: 1346) | RLSFDDSAYY TSTLRYAY (SEQ ID NO: 1380) |
| 2CL59 | AISTSGGSTA (SEQ ID NO: 1307) | AISTSGGSTAYADSVKG (SEQ ID NO: 1347) | RLSFSGSSYY QGPLQYPY (SEQ ID NO: 1381) |
| 2CL16 | AISRSAGSTY (SEQ ID NO: 1308) | AISRSAGSTYHVDSVKG (SEQ ID NO: 1348) | RLTFNLIDYYT AETRYTY (SEQ ID NO: 1382) |
| 2CL91 | AISTSGGTTD (SEQ ID NO: 1309) | AISTSGGTTDYVDSVKG (SEQ ID NO: 1349) | RLDFSSTDLY TTAPRYPY (SEQ ID NO: 1383) |
| 2CL15 | DINMVGITD (SEQ ID NO: 1310) | DINMVGITDYSDPVKG (SEQ ID NO: 1350) | GRPIGLYYPS PRIRDYND (SEQ ID NO: 1384) |
| 2CL81 | AIATNGGTTY (SEQ ID NO: 1311) | AIATNGGTTYYVDSVKG (SEQ ID NO: 1351) | RLSFGSGYYT NKLNYAY (SEQ ID NO: 1385) |
| 1CL81 | TLTRGGDDTY (SEQ ID NO: 1312) | TLTRGGDDTYCADSVKG (SEQ ID NO: 1352) | RLAVLSSNTY CSGLWDY (SEQ ID NO: 1386) |
| 1CL56 | SINASGVRTY (SEQ ID NO: 1313) | SINASGVRTYYVDALKG (SEQ ID NO: 1353) | VGQAPMYFG VDF (SEQ ID NO: 1387) |

TABLE 9-continued

Illustrative Clec4C Binding Agent Sequences

| | | | |
|---|---|---|---|
| 2CL40 | SIRWDGDSTY (SEQ ID NO: 1314) | SIRWDGDSTYYADSVKG (SEQ ID NO: 1354) | TVSSFDESKN PRVVYPY (SEQ ID NO: 1388) |
| 2CL65 | VISRSGISN (SEQ ID NO: 1315) | VISRSGISNYVDSVKG (SEQ ID NO: 1355) | DVLLTFNKRE DS (SEQ ID NO: 1389) |
| 2CL57 | VISWRNNTY (SEQ ID NO: 1316) | VISWRNNTYYADSVKG (SEQ ID NO: 1356) | AGLGAWAG MSDYDY (SEQ ID NO: 1390) |
| 2CL56 | AINWSGDSTY (SEQ ID NO: 1317) | AINWSGDSTYYSDSMKG (SEQ ID NO: 1357) | DASGYGSAW PDRYDY (SEQ ID NO: 1391) |
| 2CL66 | AISRSGSSTS (SEQ ID NO: 1318) | AISRSGSSTSYADSVKG (SEQ ID NO: 1358) | APLVLKTTPG AYNY (SEQ ID NO: 1392) |
| 2CL34 | TISRSGSMPY (SEQ ID NO: 1319) | TISRSGSMPYYADSVKG (SEQ ID NO: 1359) | NVLVTTTRLD QYDS (SEQ ID NO: 1393) |
| 2CL46 | AVEWSSGSTF (SEQ ID NO: 1320) | AVEWSSGSTFYTDSVKG (SEQ ID NO: 1360) | DHTGKLVFSK TSDY (SEQ ID NO: 1394) |
| 2CL29 | TISRSGSSTF (SEQ ID NO: 1321) | TISRSGSSTFYAESVKG (SEQ ID NO: 1361) | RPLVPSEDPD NYNY (SEQ ID NO: 1395) |
| 1CL88 | AISENSSILY (SEQ ID NO: 1322) | AISENSSILYYTASVKG (SEQ ID NO: 1362) | YGSTTIRTTT RPTK (SEQ ID NO: 1396) |
| 2CL68 | YISRTGGSTK (SEQ ID NO: 1323) | YISRTGGSTKYENSVKG (SEQ ID NO: 1363) | HYNGVYQDS QSYDY (SEQ ID NO: 1397) |
| 1CL82 | TINWSSGATL (SEQ ID NO: 1324) | TINWSSGATLTADSVKG (SEQ ID NO: 1364) | GATGVFRIAR AYSY (SEQ ID NO: 1398) |
| 2CL49 | GIGSNNGTL (SEQ ID NO: 1325) | GIGSNNGTLTADSVKG (SEQ ID NO: 1365) | GPTFFRIARA YPY (SEQ ID NO: 1399) |
| 1CL72 revised | AINDHGDRTK (SEQ ID NO: 1290) | AINDHGDRTKYLDSVRG (SEQ ID NO: 1327) | GPLVDYLETT PLVYTY (SEQ ID NO: 1367) |
| 2CL25 revised | TISVSGSSTD (SEQ ID NO: 1298) | TISVSGSSTDYADSVKG (SEQ ID NO: 1338) | RLSFDNTALY TSANRYSY (SEQ ID NO: 1373) |
| 2CL68 revised | YISRTGGSTK (SEQ ID NO: 1323) | YISRTGGSTKYENSVKG (SEQ ID NO: 1363) | HYNGVYQDS QSYDY (SEQ ID NO: 1397) |
| 2CL49 revised | GIGSNNGTL (SEQ ID NO: 1325) | GIGSNNGTLTADSVKG (SEQ ID NO: 1365) | GPTFFRIARA YPY (SEQ ID NO: 1399) |

SEQUENCE LISTING (1473 sequences)

SEQ ID NO: 1 - protein, 504 aa, Artificial Sequence
  Artificial polymer
MEPAGPAPGRLGPLLCLLLAASCAWSGVAGEEELQVIQPDKSVLVAAGETATLRCTATSLIPVGPIQWFRGAGPGRELIYNQKEGHFPRVTTVSDLTKRNNMDFSIRIGNITPADAGTYYCVKFRKGSPDDVEFKSGAGTELSVRAKPSAPVVSGPAARATPQHTVSFTCESHGFSPRDITLKWFKNGNELSDFQTNVDPVGESVSYSIHSTAKVVLTREDVHSQVICEVAHVTLQGDPLRGTANLSETIRVPPTLEVTQQPVRAENQVNVTCQVRKFYPQRLQLTWLENGNVSRTETASTVTENKDGTYNWMSWLLVNVSAHRDDVKLTCQVEHDGQPAVSKSHDLKVSAHPKEQGSNTAAENTGSNERNIYIVVGVVCTLLVALLMAALYLVRIRQKKAQGSTSSTRLHEPEKNAREITQDTNDITYADLNLPKGKKPAPQAAEPNNHTEYASIQTSPQPASEDTLTYADLDMVHLNRTPKQPAPKPEPSFSEYASVQVPRK

SEQ ID NO: 2 - protein, 474 aa, Artificial Sequence
  Artificial polymer
EEELQVIQPDKSVLVAAGETATLRCTATSLIPVGPIQWFRGAGPGRELIYNQKEGHFPRVTTVSDLTKRNNMDFSIRIGNITPADAGTYYCVKFRKGSPDDVEFKSGAGTELSVRAKPSAPVVSGPAARATPQHTVSFTCESHGFSPRDITLKWFKNGNELSDFQTNVDPVGESVSYSIHSTAKVVLTREDVHSQVICEVAHVTLQGDPLRGTANLSETIRVPPTLEVTQQPVRAENQVNVTCQVRKFYPQRLQLTWLENGNVSRTETASTVTENKDGTYNWMSWLLVNVSAHRDDVKLTCQVEHDGQPAVSKSHDLKVSAHPKEQGSNTAAENTGSNERNIYIVVGVVCTLLVALLMAALYLVRIRQKKAQGSTSSTRLHEPEKNAREITQDTNDITYADLNLPKGKKPAPQAAEPNNHTEYASIQTSPQPASEDTLTYADLDMVHLNRTPKQPAPKPEPSFSEYASVQVPRK

SEQ ID NO: 3 - protein, 508 aa, Artificial Sequence
  Artificial polymer
MEPAGPAPGRLGPLLCLLLAASCAWSGVAGEEELQVIQPDKSVLVAAGETATLRCTATSLIPVGPIQWFRGAGPGRELIYNQKEGHFPRVTTVSDLTKRNNMDFSIRIGNITPADAGTYYCVKFRKGSPDDVEFKSGAGTELSVRAKPSAPVVSGPAARATPQHTVSFTCESHGFSPRDITLKWFKNGNELSDFQTNVDPVGESVSYSIHSTAKVVLTREDVHSQVICEVAHVTLQGDPLRGTANLSETIRVPPTLEVTQQPVRAENQVNVTCQVRKFYPQRLQLTWLENGNVSRTETASTVTENKDGTYNWMSWLLVNVSAHRDDVKLTCQVEHDGQPAVSKSHDLKVSAHPKEQGSNTAAENTGSNERNIYIVVGVVCTLLVALLMAALYLVRIRQKKAQGSTSSTRLHEPEKNAREITQVQSLDTNDITYADLNLPKGKKPAPQAAEPNNHTEYASIQTSPQPASEDTLTYADLDMVHLNRTPKQPAPKPEPSFSEYASVQVPRK

SEQ ID NO: 4 - protein, 503 aa, Artificial Sequence
  Artificial polymer
MEPAGPAPGRLGPLLCLLLAASCAWSGVAGEEELQVIQPDKSVLVAAGETATLRCTATSLIPVGPIQWFRGAGPGRELIYNQKEGHFPRVTTVSDLTKRNNMDFSIRIGNITPADAGTYYCVKFRKGSPDVEFKSGAGTELSVRAKPSAPVVSGPAARATPQHTVSFTCESHGFSPRDITLKWFKNGNELSDFQTNVDPVGESVSYSIHSTAKVVLTREDVHSQVICEVAHVTLQGDPLRGTANLSETIRVPPTLEVTQQPVRAENQVNVTCQVRKFYPQRLQLTWLENGNVSRTETASTVTENKDGTYNWMSWLLVNVSAHRDDVKLTCQVEHDGQPAVSKSHDLKVSAHPKEQGSNTAAENTGSNERNIYIVVGVVCTLLVALLMAALYLVRIRQKKAQGSTSSTRLHEPEKNAREITQDTNDITYADLNLPKGKKPAPQAAEPNNHTEYASIQTSPQPASEDTLTYADLDMVHLNRTPKQPAPKPEPSFSEYASVQVPRK

SEQ ID NO: 5-45 - skipped (41 entries)

SEQ ID NO: 46 - protein, 165 aa, Artificial Sequence
  Artificial polymer
CDLPQTHSLGSRRTLMLLAQMRKISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 47 - protein, 165 aa, Artificial Sequence [sequence omitted]

SEQ ID NO: 48 - protein, 166 aa, Artificial Sequence
  Artificial polymer
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 49 - protein, 167 aa, Artificial Sequence
  Artificial polymer
MCDLPQTHSLGNRRALILLAQMRRISPFSCLKDRHDFGFPQEEFDGNQFQKAQAISVLHEMIQQTFNLFSTKDSSAAWDESLLEKFYTELYQQLNDLEACVIQEVGVEETPLMNVDSILAVKKYFQRITLYLTEKKYSPCAWEVVRAEIMRSFSLSTNLQERLRRKE

SEQ ID NO: 50 - protein, 166 aa, Artificial Sequence
  Artificial polymer
CDLPQTHSLGNRRALILLAQMRRISPFSCLKDRHDFGFPQEEFDGNQFQKAQAISVLHEMIQQTFNLFSTKDSSAAWDESLLEKFYTELYQQLNDLEACVIQEVGVEETPLMNVDSILAVKKYFQRITLYLTEKKYSPCAWEVVRAEIMRSFSLSTNLQERLRRKE

SEQ ID NO: 51 - protein, 166 aa, Artificial Sequence
  Artificial polymer
CDLPQTHSLGNRRTLMLLAQMRRISPFSCLKDRHDFGFPQEEFDGNQFQKAQAISVLHEMIQQTFNLFSTKDSSAAWDESLLEKFYTELYQQLNDLEACVIQEVGVEETPLMNVDSILAVKKYFQRITLYLTEKKYSPCAWEVVRAEIMRSFSLSTNLQERLRRKE

SEQ ID NO: 52 - protein, 166 aa, Artificial Sequence
  Artificial polymer
CDLPQTHSLGNRRALILLAQMRRISPFSCLKDRHDFGFPQEEFDGNQFQKAQAISVLHEMIQQTFNLFSTKDSSAAWDESLLEKFYTELYQQLNDLEACVIQEVGVEETPLMNEDSILAVRKYFQRITLYLTEKKYSPCAWEVVRAEIMRSFSLSTNLQERLRRKE

SEQ ID NO: 53 - protein, 167 aa, Artificial Sequence
  Artificial polymer
MCDLPQTHSLGNRRALILLAQMRRISPFSCLKDRHDFGFPQEEFDGNQFQKAQAISVLHEMIQQTFNLFSTKDSSAAWDESLLEKFYTELYQQLNDLEACVIQEVGVEETPLMNEDSILAVRKYFQRITLYLTEKKYSPCAWEVVRAEIMRSFSLSTNLQERLRRKE

SEQ ID NO: 54 - protein, 167 aa, Artificial Sequence
  Artificial polymer
MCDLPQTHSLGNRRALILLAQMRRISPFSCLKDRHDFGFPQEEFDGNQFQKAQAISVLHEMIQQTFNLFSTKDSSAAWDESLLEKFYTELYQQLNDLEACVIQEVGVEETPLMNEDSILAVRKYFQRITLYLTEKKYSPCAWEVVRAEIMRSFSLCTNLQERLRRKE

SEQ ID NO: 55 - protein, 165 aa, Artificial Sequence
  Artificial polymer
APMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQENPCGPCSERRKHLFVQDPQTCKCSCKNTDSRCKARQLELNERTCRCDKPRR

SEQ ID NO: 56 - protein, 165 aa, Artificial Sequence
  Artificial polymer
APMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQENPCGPCSERRKHLFVQDPQTCKCSCKNTDSRCKARQLELNERTCRSLTRKD

SEQ ID NO: 57 - protein, 157 aa, Artificial Sequence [sequence omitted]

SEQ ID NO: 58 - protein, 171 aa, Artificial Sequence
  Artificial polymer
LPGVGLTPSAAQTARQHPKMHLAHSNLKPAAHLIGDPSKQNSLLWRANTDRAFLQDGFSLSNNSLLVPTSGIYFVYSQVVFSGKAYSPKATSSPLYLAHEVQLFSSQYPFHVPLLSSQKMVYPGLQEPWLHSMYHGAAFQLTQGDQLSTHTDGIPHLVLSPSTVFFGAFAL

SEQ ID NO: 59 - protein, 281 aa, Artificial Sequence [sequence omitted]

SEQ ID NO: 60 - protein, 153 aa, Artificial Sequence
  Artificial polymer
APVRSLNCTLRDSQQKSLVMSGPYELKALHLQGQDMEQQVVFSMSFVQGEESNDKIPVALGLKEKNLYLSCVLKDDKPTLQLESVDPKNYPKKKMEKRFVFNKIEINNKLEFESAQFPNWYISTSQAENMPVFLGGTKGGQDITDFTMQFVSS

SEQ ID NO: 61 - protein, 133 aa, Artificial Sequence [sequence omitted]

SEQ ID NO: 62 - protein, 129 aa, Artificial Sequence [sequence omitted]

SEQ ID NO: 63 - protein, 185 aa, Artificial Sequence
  Artificial polymer
APVPPGEDSKDVAAPHRQPLTSSERIDKQIRYILDGISALRKETCNKSNMCESSKEALAENNLNLPKMAEKDGCFQSGFNEETCLVKIITGLLEFEVYLEYLQNRFESSEEQARAVQMSTKVLIQFLQKKAKNLDAITTPDPTTNASLTTKLQAQNQWLQDMTTHLILRSFKEFLQSSLRALRQM

SEQ ID NO: 64 - protein, 114 aa, Artificial Sequence
  Artificial polymer
SPGPVPPSTALRELIEELVNITQNQKAPLCNGSMVWSINLTAGMYCAALESLINVSGCSAIEKTQRMLSGFCPHKVSAGQFSSLHVRDTKIEVAQFVKDLLLHLKKLFREGRFN

SEQ ID NO: 65 - protein, 194 aa, Artificial Sequence
  Artificial polymer
MAAEPVEDNCINFVAMKFIDNTLYFIAEDDENLESDYFGKLESKLSVIRNLNDQVLFIDQGNRPLFEDMTDSDCRDNAPRTIFIISMYKDSQPRGMAVTISVKCEKISTLSCENKIISFKEMNPPDNIKDTKSDIIFFQRSVPGHDNKMQFESSSYEGYFLACEKERDLFKLILKKEDELGDRSIMFTVQNEDL

SEQ ID NO: 66 - protein, 270 aa, Artificial Sequence
  Artificial polymer
MKPKMKYSTNKISTAKWKNTASKALCFKLGKSQQKAKEVCPMYFMKLRSGLMIKKEACYFRRETTKRPSLKTGRKHKRHLVLAACQQQSTVECFAFGISGVQKYTRALHDSSITGISPITEYLASLSTYNDQSITFALEDESYEIYVEDLKKDEKKDKVLLSYYESQHPSNESGDGVDGKMLMVTLSPTKDFWLHANNKEHSVELHKCEKPLPDQAFFVLHNMHSNCVSFECKTDPGVFIGVKDNHLALIKVDSSENLCTENILFKLSET

SEQ ID NO: 67 - protein, 193 aa, Artificial Sequence
  Artificial polymer
MGVHECPAWLWLLLSLLSLPLGLPVLGAPPRLICDSRVLERYLLEAKEAENITTGCAEHCSLNENITVPDTKVNFYAWKRMEVGQQAVEVWQGLALLSEAVLRGQALLVNSSQPWEPLQLHVDKAVSGLRSLTTLLRALGAQKEAISPPDAASAAPLRTITADTFRKLFRVYSNFLRGKLKLYTGEACRTGDR

SEQ ID NO: 68 - protein, 166 aa, Artificial Sequence
  Artificial polymer
APPRLICDSRVLERYLLEAKEAENITTGCAEHCSLNENITVPDTKVNFYAWKRMEVGQQAVEVWQGLALLSEAVLRGQALLVNSSQPWEPLQLHVDKAVSGLRSLTTLLRALGAQKEAISPPDAASAAPLRTITADTFRKLFRVYSNFLRGKLKLYTGEACRTGDR

SEQ ID NO: 69 - protein, 447 aa, Artificial Sequence
  Artificial polymer
QVQLVQSGVEVKKPGASVKVSCKASGYTFTNYYMYWVRQAPGQGLEWMGGINPSNGGTNFNEKFKNRVTLTTDSSTTTAYMELKSLQFDDTAVYYCARRDYRFDMGFDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 70 - protein, 218 aa, Artificial Sequence
  Artificial polymer
EIVLTQSPATLSLSPGERATLSCRASKGVSTSGYSYLHWYQQKPGQAPRLLIYLASYLESGVPARFSGSGSGTDFTLTISSLEPEDFAVYYCQHSRDLPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 71 - protein, 440 aa, Artificial Sequence
  Artificial polymer
QVQLVESGGGVVQPGRSLRLDCKASGITFSNSGMHWVRQAPGKGLEWVAVIWYDGSKRYYADSVKGRFTISRDNSKNTLFLQMNSLRAEDTAVYYCATNDDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 72 - protein, 214 aa, Artificial Sequence
  Artificial polymer
EIVLTQSPATLSLSPGERATLSCRASQSVSSYLAWYQQKPGQAPRLLIYDASNRATGIPARFSGSGSGTDFTLTISSLEPEDFAVYYCQQSSNWPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 73 - protein, 106 aa, Artificial Sequence
  Artificial polymer
EIVLTQSPSSLSASVGDRVTITCSARSSVSYMHWYQQKPGKAPKLLIYRTSNLASGVPSRFSGSGSGTDFTLTINSLQPEDFATYYCQQRSSFPLTFGGGTKLEIK

SEQ ID NO: 74 - protein, 106 aa, Artificial Sequence
  Artificial polymer
EIVLTQSPSSLSASVGDRVTITCSARSSVSYMHWFQQKPGKAPKLWIYRTSNLASGVPSRFSGSGSGTDYTLTINSLQPEDFATYYCQQRSSFPLTFGGGTKLEIK

SEQ ID NO: 75 - protein, 106 aa, Artificial Sequence
  Artificial polymer
EIVLTQSPSSLSASVGDRVTITCSARSSVSYMHWFQQKPGKAPKLWIYRTSNLASGVPSRFSGSGSGTDYCLTINSLQPEDFATYYCQQRSSFPLTFGGGTKLEIK

SEQ ID NO: 76 - protein, 106 aa, Artificial Sequence
  Artificial polymer
EIVLTQSPSSLSASVGDRVTITCSARSSVSYMHWFQQKPGKAPKLWIYRTSNLASGVPSRFSGSGSGTSYCLTINSLQPEDFATYYCQQRSSFPLTFGGGTKLEIK

SEQ ID NO: 77 - protein, 117 aa, Artificial Sequence
  Artificial polymer
QVQLVQSGSELKKPGASVKISCKASGYSFSNYGMNWVRQAPGQGLQWMGWINTDSGESTYAEEFKGRFVFSLDTSVSTAYLQITSLTAEDTGMYFCAKVGYDALDYWGQGTLVTVSS

SEQ ID NO: 78 - protein, 117 aa, Artificial Sequence
  Artificial polymer
QVQLVQSGSELKKPGASVKISCKASGYTFTNYGMNWVRQAPGQGLQWMGWINTDSGESTYAEEFKGRFVFSLDTSVSTAYLQITSLTAEDTGMYFCAKVGYDALDYWGQGTLVTVSS

SEQ ID NO: 79 - protein, 117 aa, Artificial Sequence
  Artificial polymer
QVQLVQSGSELKKPGASVKISCKASGYTFTNYGMNWVRQAPGQGLQWMGWINTDSGESTYAEEFKGRFVFSLDTSVNTAYLQITSLTAEDTGMYFCVRVGYDALDYWGQGTLVTVSS

SEQ ID NO: 80 - protein, 117 aa, Artificial Sequence
  Artificial polymer
QIQLVQSGSELKKPGASVKISCKASGYTFTNYGMNWVRQAPGQGLQWMGWINTDSGESTYAEEFKGRFVFSLDTSVNTAYLQITSLTAEDTGMYFCVRVGYDALDYWGQGTLVTVSS

SEQ ID NO: 81 - protein, 117 aa, Artificial Sequence
  Artificial polymer
QIQLVQSGSELKKPGASVKISCKASGYTFTNYGMNWVKQAPGQGLKWMGWINTDSGESTYAEEFKGRFAFSLDTSVNTAYLQITSLNAEDTGMYFCVRVGYDALDYWGQGTLVTVSS

SEQ ID NO: 82 - protein, 254 aa, Artificial Sequence
  Artificial polymer
LFTVTVPKELYIIEHGSNVTLECNFDTGSHVNLGAITASLQKVENDTSPHRERATLLEEQLPLGKASFHIPQVQVRDEGQYQCIIIYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPTWLLHIFIPFCIIAFIFIATVIALRKQLCQKLYSSKDTTKRPVTTTKREVNSAI

SEQ ID NO: 83 - protein, 453 aa, Artificial Sequence
  Artificial polymer
MIFLLLMLSLELQLHQIAALFTVTVPKELYIIEHGSNVTLECNFDTGSHVNLGAITASLQKVENDTSPHRERATLLEEQLPLGKASFHIPQVQVRDEGQYQCIIIYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPTWEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 84 - protein, 22 aa, Artificial Sequence
  Artificial polymer
SNTSESFKFRVTQLAPKAQIKE

SEQ ID NO: 85 - protein, 119 aa, Artificial Sequence
  Artificial polymer
EVQLQQSGPVLVKPGASVKMSCKASGYTFTDYYMNWVKQSHGKSLEWIGNINPYNGGTTYNQKFKGKATLTVDKSSRTAYMEINSLTSEDSAVYYCARGRIYDGSLDYWGQGTALTVSS

SEQ ID NO: 86 - protein, 106 aa, Artificial Sequence
  Artificial polymer
DIQMTQFPSSLCASQGGKVTVTCKASQDINNYMAWYQHKPGKGPRLLIHYTSTLLSGIPSRFSGSGSGRDYSFSISNLEPEDIATYYCLQYDNLWTFGGGTKLEIK

SEQ ID NO: 87 - protein, 116 aa, Artificial Sequence
  Artificial polymer
QVQLQQSGAELAKPGASVRLSCKASGYTFTNYWMHWVKQRPGQGLEWIGHINPSSGFTTYNQNFKDKATLTADKSSNTAYMQLSSLTYEDSAVYFCAREDYDVDYWGQGTTLTVSS

SEQ ID NO: 88 - protein, 107 aa, Artificial Sequence
  Artificial polymer
DIVMTQSQKFMSTSVGDRVSVTCKASQSVDTNVAWYQQKPGQSPKALIFSASYRYSGVPDRFTGSGSGTDFTLTINSVQSEDLAEYFCQQYNSYPYTFGSGTKLEIK

SEQ ID NO: 89 - protein, 122 aa, Artificial Sequence
  Artificial polymer
EVQLVESGGGLVKPGGSLKLSCAASGFTFSDYGMHWVRQAPEKGLEWVAYISSGSYTIYYTDTVKGRFTISRDNAKNTLFLQMTSLRSEDTAMYYCARRGYGSFYEYYFDYWGQGTTLTVSS

SEQ ID NO: 90 - protein, 106 aa, Artificial Sequence
  Artificial polymer
QIVLTQSPALMSASPGEKVTMTCSASSSVSYMYWYQQKPRSSPKPWIYLTSNLASGVPARFSGSGSGTSYSLTISSMEAEDAATYYCQQWSSNPFTFGSGTKLEIK

SEQ ID NO: 91 - protein, 119 aa, Artificial Sequence
  Artificial polymer
EVQLVESGGGLVQAGKSLRLSCAASGSIFSIHAMGWFRQAPGKEREFVAAITWSGGITYYEDSVKGRFTISRDNAKNTVYLQMNSLKPEDTAIYYCAADRAESSWYDYWGQGTQVTVSS

SEQ ID NO: 92 - protein, 119 aa, Artificial Sequence
  Artificial polymer
EVQLVESGGGLVQAGGSLRLSCAASGSIASIHAMGWFRQAPGKEREFVAVITWSGGITYYADSVKGRFTISRDNAKNTVYLQMNSLKPEDTAIYYCAGDKHQSSWYDYWGQGTQVTVSS

SEQ ID NO: 93 - protein, 119 aa, Artificial Sequence
  Artificial polymer
EVQLVESGGGLVQAGGSLRLSCAASGSISSIHAMGWFRQAPGKEREFVAAITWSGGITYYADSLKGRFTISRDNAKNTGYLQMNSLKPEDTAIYYCAADRAQSSWYDYWGQGTQVTVSS

SEQ ID NO: 94 - protein, 119 aa, Artificial Sequence
  Artificial polymer
EVQLVESGGGLVQAGGSLGLSCAASGSIFSINAMAWFRQAPGKEREFVALISWSGGSTYYEDSVKGRFTISRDNAKNTVYLQMNSLKPEDTAIYYCAADRVDSNWYDYWGQGTQVTVSS

SEQ ID NO: 95 - protein, 120 aa, Artificial Sequence
  Artificial polymer
EVQLVESGGGLVQAGGSLRLSCAASGRAFSSGTMGWFRRAPGKEREFVASIPWSGGRIYYADSVKGRFTISRDNAQNTVYLQMNSLKPEDTAVYYCAVKERSTGWDFASWGQCTQVTVSS

SEQ ID NO: 96 - protein, 121 aa, Artificial Sequence
  Artificial polymer
QVQLVQSGAELKQPGASVKMSCKASGYSFTSSWIHWVKQAPGQGLEWIGYIYPSTGFTEYNQKFKDRATLTADKSTSTAYMELSSLRSEDSAVYYCARWRDSSGYHAMDYWGQGTSVTVSS

SEQ ID NO: 97 - protein, 121 aa, Artificial Sequence
  Artificial polymer
QVQLVQSGAEVKQPGASVKMSCKASGYSFTSSWIHWVKQAPGQGLEWIGYIYPSTGFTEYNQKFKDRATLTADKSTSTAYMELSSLRSEDTAVYYCARWRDSSGYHAMDYWGQGTSVTVSS

SEQ ID NO: 98 - protein, 121 aa, Artificial Sequence
  Artificial polymer
QVQLVQSGHEVKQPGASVKMSCKASGYSFTSSWIHWVKQAPGQGLEWIGYIYPSTGFTEYNQKFKDRATLTADKSTSTAYMELSSLRSEDTAVYYCARWRDSSGYHAMDYWGQGTLVTVSS

SEQ ID NO: 99 - protein, 121 aa, Artificial Sequence
  Artificial polymer
QVQLVQSGHEVKQPGASVKMSCKASGYSFTSSWIHWVRQAPGQGLEWIGYIYPSTGFTEYNQKFKDRATLTADKSTSTAYMELSSLRSEDTAVYYCARWRDSSGYHAMDYWGQGTLVTVSS

SEQ ID NO: 100 - protein, 121 aa, Artificial Sequence
  Artificial polymer
QVQLVQSGHEVKQPGASVKVSCKASGYSFTSSWIHWVRQAPGQGLEWIGYIYPSTGFTEYNQKFKDRATITADKSTSTAYMELSSLRSEDTAVYYCARWRDSSGYHAMDYWGQGTLVTVSS

SEQ ID NO: 101 - protein, 111 aa, Artificial Sequence
  Artificial polymer
DIVLTQSPASLTLSPGQRLTISCRASQSVSTSGYSYMHWYQQKPDQSPKLLIKFGSNLESGIPARFSGSGSGTDFTLTISSLEEEDFATYYCQHSWEIPYTFGQGTKLEIK

SEQ ID NO: 102 - protein, 111 aa, Artificial Sequence
  Artificial polymer
DIVLTQSPATLSLSPGQRLTISCRASQSVSTSGYSYMHWYQQKPDQSPKLLIKFGSNLESGIPARFSGSGSGTDFTLTISSLEPEDFATYYCQHSWEIPYTFGQGTKLEIK

SEQ ID NO: 103 - protein, 111 aa, Artificial Sequence
  Artificial polymer
EIVLTQSPATLSLSPGQRLTISCRASQSVSTSGYSYMHWYQQKPDQSPKLLIKFGSNLESGIPARFSGSGSGTDFTLTISSLEPEDFATYYCQHSWEIPYTFGQGTKLEIK

SEQ ID NO: 104 - protein, 111 aa, Artificial Sequence
  Artificial polymer
DIVLTQSPATLSLSPGQRLTISCRASQSVSTSGYSYMHWYQQKPDQSPKLLIKFGSNLESGIPARFSGSGSGTDFTLTISSLEPEDFAVYYCQHSWEIPYTFGQGTKLEIK

SEQ ID NO: 105 - protein, 451 aa, Artificial Sequence
  Artificial polymer
EVQLVESGGGLVQPGGSLRLSCAASGFTFSRYWMSWVRQAPGKGLEWVANIKQDGSEKYYVDSVKGRFTISRDNAKNSLYLQMNSLRAEDTAVYYCAREGGWFGELAFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 106 - protein, 215 aa, Artificial Sequence
  Artificial polymer
EIVLTQSPGTLSLSPGERATLSCRASQRVSSSYLAWYQQKPGQAPRLLIYDASSRATGIPDRFSGSGSGTDFTLTISRLEPEDFAVYYCQQYGSLPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 107 - protein, 121 aa, Artificial Sequence
  Artificial polymer
EVQLVESGGGLVQPGGSLRLSCAASGFTFSRYWMSWVRQAPGKGLEWVANIKQDGSEKYYVDSVKGRFTISRDNAKNSLYLQMNSLRAEDTAVYYCAREGGWFGELAFDYWGQGTLVTVSS

SEQ ID NO: 108 - protein, 108 aa, Artificial Sequence
  Artificial polymer
EIVLTQSPGTLSLSPGERATLSCRASQRVSSSYLAWYQQKPGQAPRLLIYDASSRATGIPDRFSGSGSGTDFTLTISRLEPEDFAVYYCQQYGSLPWTFGQGTKVEIK

SEQ ID NO: 109 - protein, 448 aa, Artificial Sequence
  Artificial polymer
EVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 110 - protein, 214 aa, Artificial Sequence
  Artificial polymer
DIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 111 - protein, 450 aa, Artificial Sequence
  Artificial polymer
EVQLLESGGGLVQPGGSLRLSCAASGFTFSSYIMMWVRQAPGKGLEWVSSIYPSGGITFYADTVKGRFTISRDNSKNTLYLQMNSLRAEDTAVYYCARIKLGTVTTVDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 112 - protein, 216 aa, Artificial Sequence
  Artificial polymer
QSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTRVFGTGTKVTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS

SEQ ID NO: 113 - protein, 123 aa, Artificial Sequence
  Artificial polymer
QVQLVQSGAEVKKPGSSVKVSCKTSGDTFSTYAISWVRQAPGQGLEWMGGIIPIFGKAHYAQKFQGRVTITADESTSTAYMELSSLRSEDTAVYFCARKFHFVSGSPFGMDVWGQGTTVTVSS

SEQ ID NO: 114 - protein, 106 aa, Artificial Sequence
  Artificial polymer
EIVLTQSPATLSLSPGERATLSCRASQSVSSYLAWYQQKPGQAPRLLIYDASNRATGIPARFSGSGSGTDFTLTISSLEPEDFAVYYCQQRSNWPTFGQGTKVEIK

SEQ ID NO: 115 - protein, 117 aa, Artificial Sequence
  Artificial polymer
QVQLVQSGAEVKKPGASVKVSCKASGYTFTDYGFSWVRQAPGQGLEWMGWITAYNGNTNYAQKLQGRVTMTTDTSTSTVYMELRSLRSDDTAVYYCARDYFYGMDVWGQGTTVTVSS

SEQ ID NO: 116 - protein, 107 aa, Artificial Sequence
  Artificial polymer
EIVLTQSPATLSLSPGERATLSCRASQSVSSYLVWYQQKPGQAPRLLIYDASNRATGIPARFSGSGSGTDFTLTISSLEPEDFAVYYCQQRSNWPRTFGQGTKVEIK

SEQ ID NO: 117 - protein, 118 aa, Artificial Sequence
  Artificial polymer
QVQLVQSGAEVKKPGASVKVSCKASGYTFTSYDVHWVRQAPGQRLEWMGWLHADTGITKFSQKFQGRVTITRDTSASTAYMELSSLRSEDTAVYYCARERIQLWFDYWGQGTLVTVSS

SEQ ID NO: 118 - protein, 107 aa, Artificial Sequence
  Artificial polymer
DIQMTQSPSSLSASVGDRVTITCRASQGISSWLAWYQQKPEKAPKSLIYAASSLQSGVPSRFSGSGSGTDFTLTISSLQPEDFATYYCQQYNSYPYTFGQGTKLEIK

SEQ ID NO: 119 - protein, 120 aa, Artificial Sequence
  Artificial polymer
QVQLVQSGAEVKKPGSSVKVSCKVSGGIFSTYAINWVRQAPGQGLEWMGGIIPIFGTANHAQKFQGRVTITADESTSTAYMELSSLRSEDTAVYYCARDQGIAAALFDYWGQGTLVTVSS

SEQ ID NO: 120 - protein, 108 aa, Artificial Sequence
  Artificial polymer
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPWTFGQGTKVEIK

SEQ ID NO: 121 - protein, 113 aa, Artificial Sequence
  Artificial polymer
EVQLVESGGGLVQPGRSLRLSCAVSGFTFDDYVVHWVRQAPGKGLEWVSGISGNSGNIGYADSVKGRFTISRDNAKNSLYLQMNSLRAEDTALYYCAVPFDYWGQGTLVTVSS

SEQ ID NO: 122 - protein, 107 aa, Artificial Sequence; identical to SEQ ID NO: 118
  Artificial polymer

SEQ ID NO: 123 - protein, 123 aa, Artificial Sequence
  Artificial polymer
QVQLVQSGAEVKKPGSSVKVSCKTSGDTFSSYAISWVRQAPGQGLEWMGGIIPIFGRAHYAQKFQGRVTITADESTSTAYMELSSLRSEDTAVYFCARKFHFVSGSPFGMDVWGQGTTVTVSS

SEQ ID NO: 124 - protein, 106 aa, Artificial Sequence; identical to SEQ ID NO: 114
  Artificial polymer

SEQ ID NO: 125 - protein, 123 aa, Artificial Sequence
  Artificial polymer
QVQLVQSGAEVKKPGSSVKVSCKTSGGTFSSYAISWVRQAPGQGLEWMGGIIPIFGKAHYAQKFQGRVTITADESTTTAYMELSSLRSEDTAVYYCARKYDYVSGSPFGMDVWGQGTTVTVSS

SEQ ID NO: 126 - protein, 106 aa, Artificial Sequence; identical to SEQ ID NO: 114
  Artificial polymer

SEQ ID NO: 127 - protein, 121 aa, Artificial Sequence
  Artificial polymer
QVQLVQSGAEVKKPGSSVKVSCKASGGTFSSYAINWVRQAPGQGLEWMGGIIPIFGSANYAQKFQDRVTITADESTSAAYMELSSLRSEDTAVYYCARDSSGWSRYYMDVWGQGTTVTVSS

SEQ ID NO: 128 - protein, 106 aa, Artificial Sequence
  Artificial polymer
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPFGGGTKVEIK

SEQ ID NO: 129 - protein, 123 aa, Artificial Sequence
  Artificial polymer
QVQLVQSGAEVKEPGSSVKVSCKASGGTFNSYAISWVRQAPGQGLEWMGGIIPLFGIAHYAQKFQGRVTITADESTNTAYMDLSSLRSEDTAVYYCARKYSYVSGSPFGMDVWGQGTTVTVSS

SEQ ID NO: 130 - protein, 106 aa, Artificial Sequence
  Artificial polymer
EIVLTQSPATLSLSPGERATLSCRASQSVSSYLAWYQQKPGQAPRLLIYDASNRATGIPARFSGSGSGTDFTLTISSLEPEDFAVYYCQQRSNWPTFGQGTRLEIK

SEQ ID NO: 131 - protein, 121 aa, Artificial Sequence
  Artificial polymer
EVQLVESGGGLVQPGRSLRLSCAASGITFDDYGMHWVRQAPGKGLEWVSGISWNRGRIEYADSVKGRFTISRDNAKNSLYLQMNSLRAEDTALYYCAKGRFRYFDWFLDYWGQGTLVTVSS

SEQ ID NO: 132 - protein, 107 aa, Artificial Sequence
  Artificial polymer
AIQLTQSPSSLSASVGDRVTITCRASQGISSALAWYQQKPGKAPKLLIYDASSLESGVPSRFSGSGSGTDFTLTISSLQPEDFATYYCQQFNSYPFTFGPGTKVDIK

SEQ ID NO: 133 - protein, 118 aa, Artificial Sequence
  Artificial polymer
EVKLQESGPSLVKPSQTLSLTCSVTGYSITSDYWNWIRKFPGNKLEYVGYISYTGSTYYNPSLKSRISITRDTSKNQYYLQLNSVTSEDTATYYCARYGGWLSPFDYWGQGTTLTVSS

SEQ ID NO: 134 - protein, 107 aa, Artificial Sequence
  Artificial polymer
DIVMTQSHKLMSTSVGDRVSITCKASQDVGTAVAWYQQKPGQSPKLLIYWASTRHTGVPDRFTGSGSGTDFTLTISNVQSEDLADYFCQQDSSYPLTFGAGTKVELK

SEQ ID NO: 135 - protein, 120 aa, Artificial Sequence
  Artificial polymer
EVQLQESGPGLVAPSQSLSITCTVSGFSLTTYSINWIRQPPGKGLEWLGVMWAGGGTNSNSVLKSRLIISKDNSKSQVFLKMNSLQTDDTARYYCARYYGNSPYYAIDYWGQGTSVTVSS

SEQ ID NO: 136 - protein, 107 aa, Artificial Sequence
  Artificial polymer
DIVTTQSHKLMSTSVGDRVSITCKASQDVGTAVAWYQQKPGQSPKLLIYWASTRHTGVPDRFTGSGSGTDFTLTISNVQSEDLADYFCQQDSSYPLTFGAGTKVELK

SEQ ID NO: 137 - protein, 118 aa, Artificial Sequence
  Artificial polymer
EVKLQESGPSLVKPSQTLSLTCSVTGYSIISDYWNWIRKFPGNKLEYLGYISYTGSTYYNPSLKSRISITRDTSKNQYYLQLNSVTTEDTATYYCARRGGWLLPFDYWGQGTTLTVSS

SEQ ID NO: 138 - protein, 113 aa, Artificial Sequence
  Artificial polymer
DIVMTQSPSSLAVSVGEKVSMGCKSSQSLLYSSNQKNSLAWYQQKPGQSPKLLIDWASTRESGVPDRFTGSGSGTDFTLTISSVKAEDLAVYYCQQYYGYPLTFGAGTKLELK

SEQ ID NO: 139 - protein, 118 aa, Artificial Sequence
  Artificial polymer
EVKLQESGPSLVKPGASVKLSCKASGYTFTSYDINWVKQRPGQGLEWIGWIFPRDNNTKYNENFKGKATLTVDTSSTTAYMELHSLTSEDSAVYFCTKENWVGDFDYWGQGTTLTLSS

SEQ ID NO: 140 - protein, 106 aa, Artificial Sequence
  Artificial polymer
DIVMTQSPAIMSASPGEKVTMTCSASSSIRYMHWYQQKPGTSPKRWISDTSKLTSGVPARFSGSGSGTSYALTISSMEAEDAATYYCHQRSSYPWTFGGGTKLEIK

SEQ ID NO: 141 - protein, 114 aa, Artificial Sequence
  Artificial polymer
EVQLQQSGPDLVTPGASVRISCQASGYTFPDYYMNWVKQSHGKSLEWIGDIDPNYGGTTYNQKFKGKAILTVDRSSSTAYMELRSLTSEDSAVYYCARGALTDWGQGTSLTVSS

SEQ ID NO: 142 - protein, 106 aa, Artificial Sequence
  Artificial polymer
QIVLSQSPAILSASPGEKVTMTCRASSSVSYIYWFQQKPGSSPKPWIYATFNLASGVPARFSGSGSGTSYSLTISRVETEDAATYYCQQWSNNPLTFGAGTKLELK

SEQ ID NO: 143 - protein, 115 aa, Artificial Sequence
  Artificial polymer
EVQLVQSGPELKKPGASVKMSCKASGYTFTSYVMHWVKQAPGQRLEWIGYVNPFNDGTKYNEMFKGRATLTSDKSTSTAYMELSSLRSEDSAVYYCARQAWGYPWGQGTLVTVSS

SEQ ID NO: 144 - protein, 115 aa, Artificial Sequence
  Artificial polymer
EVQLVQSGAEVKKPGASVKMSCKASGYTFTSYVMHWVKQAPGQRLEWIGYVNPFNDGTKYNEMFKGRATLTSDKSTSTAYMELSSLRSEDTAVYYCARQAWGYPWGQGTLVTVSS

SEQ ID NO: 145 - protein, 115 aa, Artificial Sequence
  Artificial polymer
EVQLVQSGAEVKKPGASVKMSCKASGYTFTSYVMHWVRQAPGQRLEWIGYVNPFNDGTKYNEMFKGRATLTSDKSTSTAYMELSSLRSEDTAVYYCARQAWGYPWGQGTLVTVSS

SEQ ID NO: 146 - protein, 115 aa, Artificial Sequence
  Artificial polymer
EVQLVQSGAEVKKPGASVKVSCKASGYTFTSYVMHWVRQAPGQRLEWIGYVNPFNDGTKYNEMFKGRATLTSDKSTSTAYMELSSLRSEDTAVYYCARQAWGYPWGQGTLVTVSS

SEQ ID NO: 147 - protein, 115 aa, Artificial Sequence
  Artificial polymer
EVQLVQSGAEVKKPGASVKVSCKASGYTFTSYVMHWVRQAPGQRLEWIGYVNPFNDGTKYNEMFKGRATITSDKSTSTAYMELSSLRSEDTAVYYCARQAWGYPWGQGTLVTVSS

SEQ ID NO: 148 - protein, 111 aa, Artificial Sequence
  Artificial polymer
DIVLTQSPASLALSPGERATLSCRATESVEYYGTSLVQWYQQKPGQPPKLLIYAASSVDSGVPSRFSGSGSGTDFTLTINSLEEEDAAMYFCQQSRRVPYTFGQGTKLEIK

SEQ ID NO: 149 - protein, 111 aa, Artificial Sequence
  Artificial polymer
DIVLTQSPATLSLSPGERATLSCRATESVEYYGTSLVQWYQQKPGQPPKLLIYAASSVDSGVPSRFSGSGSGTDFTLTINSLEAEDAAMYFCQQSRRVPYTFGQGTKLEIK

SEQ ID NO: 150 - protein, 111 aa, Artificial Sequence
  Artificial polymer
EIVLTQSPATLSLSPGERATLSCRATESVEYYGTSLVQWYQQKPGQPPKLLIYAASSVDSGVPSRFSGSGSGTDFTLTINSLEAEDAAMYFCQQSRRVPYTFGQGTKLEIK

SEQ ID NO: 151 - protein, 111 aa, Artificial Sequence
  Artificial polymer
DIVLTQSPATLSLSPGERATLSCRATESVEYYGTSLVQWYQQKPGQPPKLLIYAASSVDSGVPSRFSGSGSGTDFTLTINSLEAEDAATYFCQQSRRVPYTFGQGTKLEIK

SEQ ID NO: 152 - protein, 120 aa, Artificial Sequence
  Artificial polymer
EVQLVESGGGLVKPGGSLRLSCAASGFTFSTYSMNWVRQAPGKGLEWVSSISSSGDYIYYADSVKGRFTISRDNAKNSLFLQMNSLKAEDTAVYYCARDLVTSMVAFDYWGQGTLVTVSS

SEQ ID NO: 153 - protein, 108 aa, Artificial Sequence
  Artificial polymer
SYELTQPPSVSVSPGQAARITCSGDALPQKYVFWYQQKSGQAPVLVIYEDSKRPSGIPERFSGSSSGTMATLTISGAQVEDEADYYCYSTDRSGNHRVFGGGTRLTVL

SEQ ID NO: 154 - protein, 120 aa, Artificial Sequence
  Artificial polymer
EVQLVESGGGLVQPGGSLRLSCAASGFTFSSYWMSWVRQAPGKGLEWVANIKQDGGEQYYVDSVKGRFTISRDNAKNSLYLQMNSLRAEDTAVYYCARDWNYGYYDMDVWGQGTTVTVSS

SEQ ID NO: 155 - protein, 108 aa, Artificial Sequence
  Artificial polymer
EIVLTQSPGTLSLSPGERATLSCRASQSVSSNYLAWFQQKPGQAPRLLIFGTSSRATGIPDRFSGSGSGTDFTLTISRLEPEDFAVYYCQQYGSSIFTFGPGTKVDIK

SEQ ID NO: 156 - protein, 121 aa, Artificial Sequence; identical to SEQ ID NO: 107
  Artificial polymer

SEQ ID NO: 157 - protein, 108 aa, Artificial Sequence
  Artificial polymer
EIVLTQSPGTLSLSPGERATLSCRASQRVSSSYLAWYQQKPGQAPRLLIYDASSRATGIPDRFSGSGSGTDFTLTISRLEPEDFAVYYCQQYGSLPWTFGQGTEVEIK

SEQ ID NO: 158 - protein, 121 aa, Artificial Sequence
  Artificial polymer
EVQLLESGGGLVQPGGSLRLSCAASGFTFSNYAMSWVRQAPGKGLEWVSAIRGSGGSTYYADSVKGRFTISRDNSKNTLYLQMNSLRAEDTAVYYCAKDLHYDSSGYLDYWGQGTLVTVSS

SEQ ID NO: 159 - protein, 107 aa, Artificial Sequence
  Artificial polymer
DIQMTQSPSSVSASVGDRVTITCRASQGIRSWLAWYQQKPGKAPKLLIYAISRLQSGVPSRFSGSGSGTDFTLTISSLQPEDFATYYCQQANSFPLTFGGGTKVEIK

SEQ ID NO: 160 - protein, 119 aa, Artificial Sequence
  Artificial polymer
EVQLVESGGGLVQPGGSLRLSCAASGFTFSSYWMSWVRQAPGKGLEWVANIKQDGGEKYYVDSVKGRFTISRDNAKNSLFLQMNSLRAEDTAVYYCARVQLYSDYFDYWGQGTLVTVSS

SEQ ID NO: 161 - protein, 107 aa, Artificial Sequence
  Artificial polymer
DIQMTQSPSSVSASVGDRVTITCRASQGISSWLAWYQQKSGKAPKLLIYAASGLQSGVPSRFSGSGSGTDFTLTISSLQPEDLATYYCQQSHSLPPTFGQGTKVEIK

SEQ ID NO: 162 - protein, 121 aa, Artificial Sequence
  Artificial polymer
EVQLLESGGDLVQPGGSLRLSCAASGFTFNSYAMSWVRQAPGKGLEWVSTISGSGGFTFSADSVKGRFTISRDNSKNTLFLQMNSLRVEDSAVYSCAKVLVGFNNGCWDYWGQGTLVTVSS

SEQ ID NO: 163 - protein, 108 aa, Artificial Sequence
  Artificial polymer
SYVLTQPPSVSVAPGQTARITCGGNNIGSKSVHWYQQKPGQAPVLVVYDDSDRPSGIPERFSGSNSGNTATLTISRVEAGDEADYYCQVWDSSNDHVVFGGGTKLTVL

SEQ ID NO: 164 - protein, 120 aa, Artificial Sequence
  Artificial polymer
EVQLVESGGGLVKPGGSLRLSCAASGFTFSTYSMNWVRQAPGKGLEWVSSISSSGDYIYYADSVKGRFTISRDNAKNSLYLQMNSLRAEDTAVYYCARDLVTSMVAFDYWGQGTLVTVSS

SEQ ID NO: 165 - protein, 108 aa, Artificial Sequence
  Artificial polymer
SYELTQPPSVSVSPGQTARITCSGDALPQKYVFWYQQKSGQAPVLVIYEDSKRPSGIPERFSGSSSGTMATLTISGAQVEDEADYYCYSTDRSGNHRVFGGGTKLTVL

SEQ ID NO: 166 - protein, 121 aa, Artificial Sequence; identical to SEQ ID NO: 107
  Artificial polymer

SEQ ID NO: 167 - protein, 108 aa, Artificial Sequence; identical to SEQ ID NO: 108
  Artificial polymer

SEQ ID NO: 168 - protein, 120 aa, Artificial Sequence
  Artificial polymer
QVQLVQSGAEVKKPGASVKVSCKASGYTFTSYWMYWVRQATGQGLEWMGRIDPNSGSTKYNEKFKNRFTISRDDSKNTAYLQMNSLKTEDTAVYYCARDYRKGLYAMDYWGQGTTVTVSS

SEQ ID NO: 169 - protein, 120 aa, Artificial Sequence
  Artificial polymer
EVQLVQSGAEVKKPGATVKISCKVSGYTFTSYWMYWVRQATGQGLEWMGRIDPNSGSTKYNEKFKNRVTITADKSTSTAYMELSSLRSEDTAVYYCARDYRKGLYAMDYWGQGTTVTVSS

SEQ ID NO: 170 - protein, 120 aa, Artificial Sequence
  Artificial polymer
EVQLVQSGAEVKKPGESLRISCKGSGYTFTSYWMYWVRQAPGQGLEWMGRIDPNSGSTKYNEKFKNRVTISVDTSKNQFSLKLSSVTAADTAVYYCARDYRKGLYAMDYWGQGTTVTVSS

SEQ ID NO: 171 - protein, 120 aa, Artificial Sequence
  Artificial polymer
EVQLVQSGAEVKKPGATVKISCKVSGYTFTSYWMYWIRQSPSRGLEWLGRIDPNSGSTKYNEKFKNRLTISKDTSKNQVVLTMTNMDPVDTATYYCARDYRKGLYAMDYWGQGTTVTVSS

SEQ ID NO: 172 - protein, 120 aa, Artificial Sequence
  Artificial polymer
EVQLVQSGAEVKKPGESLRISCKGSGYTFTSYWMYWIRQPPGKGLEWIGRIDPNSGSTKYNEKFKNRVTITADKSTSTAYMELSSLRSEDTAVYYCARDYRKGLYAMDYWGQGTTVTVSS

SEQ ID NO: 173 - protein, 120 aa, Artificial Sequence
  Artificial polymer
QVQLVQSGAEVKKPGASVKVSCKASGYTFTSYWMYWIRQSPSRGLEWLGRIDPNSGSTKYNEKFKNRFTISRDDSKNTAYLQMNSLKTEDTAVYYCARDYRKGLYAMDYWGQGTTVTVSS

SEQ ID NO: 174 - protein, 120 aa, Artificial Sequence
  Artificial polymer
EVQLVQSGAEVKKPGESLRISCKGSGYTFTSYWMYWVRQARGQRLEWIGRIDPNSGSTKYNEKFKNRLTISKDTSKNQVVLTMTNMDPVDTATYYCARDYRKGLYAMDYWGQGTTVTVSS

SEQ ID NO: 175 - protein, 120 aa, Artificial Sequence
  Artificial polymer
QITLKESGPTLVKPTQTLTLTCTFSGYTFTSYWMYWVRQAPGKGLEWVSRIDPNSGSTKYNEKFKNRVTITADKSTSTAYMELSSLRSEDTAVYYCARDYRKGLYAMDYWGQGTTVTVSS

SEQ ID NO: 176 - protein, 120 aa, Artificial Sequence
  Artificial polymer
EVQLVQSGAEVKKPGATVKISCKVSGYTFTSYWMYWVRQARGQRLEWIGRIDPNSGSTKYNEKFKNRFTISRDNSKNTLYLQMNSLRAEDTAVYYCARDYRKGLYAMDYWGQGTTVTVSS

SEQ ID NO: 177 - protein, 107 aa, Artificial Sequence
  Artificial polymer
DIVMTQTPLSLPVTPGEPASISCKASQDVGTAVAWYLQKPGQSPQLLIYWASTRHTGIPARFSGSGSGTEFTLTISSLQSEDFAVYYCQQYNSYPLTFGQGTKVEIK

SEQ ID NO: 178 - protein, 107 aa, Artificial Sequence
  Artificial polymer
DIQMTQSPSSLSASVGDRVTITCKASQDVGTAVAWYLQKPGQSPQLLIYWASTRHTGVPSRFSGSGSGTDFTLTISSLQPEDFATYYCQQYNSYPLTFGQGTKVEIK

SEQ ID NO: 179 - protein, 107 aa, Artificial Sequence
  Artificial polymer
EIVLTQSPDFQSVTPKEKVTITCKASQDVGTAVAWYLQKPGQSPQLLIYWASTRHTGVPDRFSGSGSGTDFTLKISRVEAEDVGVYYCQQYNSYPLTFGQGTKVEIK

SEQ ID NO: 180 - protein, 107 aa, Artificial Sequence
  Artificial polymer
EIVLTQSPDFQSVTPKEKVTITCKASQDVGTAVAWYLQKPGQSPQLLIYWASTRHTGVPSRFSGSGSGTDFTFTISSLQPEDIATYYCQQYNSYPLTFGQGTKVEIK

SEQ ID NO: 181 - protein, 107 aa, Artificial Sequence
  Artificial polymer
EIVLTQSPATLSLSPGERATLSCKASQDVGTAVAWYLQKPGQSPQLLIYWASTRHTGIPPRFSGSGYGTDFTLTINNIESEDAAYYFCQQYNSYPLTFGQGTKVEIK

SEQ ID NO: 182 - protein, 107 aa, Artificial Sequence
  Artificial polymer
DVVMTQSPLSLPVTLGQPASISCKASQDVGTAVAWYQQKPGQAPRLLIYWASTRHTGVPSRFSGSGSGTEFTLTISSLQPDDFATYYCQQYNSYPLTFGQGTKVEIK

SEQ ID NO: 183 - protein, 107 aa, Artificial Sequence
  Artificial polymer
DIQMTQSPSSLSASVGDRVTITCKASQDVGTAVAWYQQKPGQAPRLLIYWASTRHTGVPSRFSGSGSGTDFTFTISSLQPEDIATYYCQQYNSYPLTFGQGTKVEIK

SEQ ID NO: 184 - protein, 107 aa, Artificial Sequence
  Artificial polymer
AIQLTQSPSSLSASVGDRVTITCKASQDVGTAVAWYLQKPGQSPQLLIYWASTRHTGVPSRFSGSGSGTDFTFTISSLEAEDAATYYCQQYNSYPLTFGQGTKVEIK

SEQ ID NO: 185 - protein, 107 aa, Artificial Sequence
  Artificial polymer
EIVLTQSPDFQSVTPKEKVTITCKASQDVGTAVAWYQQKPGQAPRLLIYWASTRHTGVPSRFSGSGSGTEFTLTISSLQPDDFATYYCQQYNSYPLTFGQGTKVEIK

SEQ ID NO: 186 - protein, 116 aa, Artificial Sequence
  Artificial polymer
EVKLVESGGGLVKPGGSLKLSCAASGFIFRSYGMSWVRQTPEKRLEWVASISSGGSTYYPDSVKGRFTISRDNARNILYLQMSSLRSEDTAMYDCARGYDSGFAYWGQGTLVTVSE

SEQ ID NO: 187 - protein, 116 aa, Artificial Sequence
  Artificial polymer
EVKLVESGGGLVKPGGSLKLSCAASGFTFRSYGMSWVRQTPEKRLEWVASISSGGTTYYPDSVKGRFIISRDNARNILYLQMSSLRSEDTAMYYCAKGYDSGFAYWGQGTLVIVSA

SEQ ID NO: 188 - protein, 116 aa, Artificial Sequence
  Artificial polymer
QVQLKQSGPGLVQPSQSLSITCTVSGFSLTTYGVHWVRQSPGKGLEWLGVIWRGVTTDYNAAFMSRLTITKDNSKSQVFFKMNSLQANDTAIYYCARLGFYAMDYWGQGTSVTVSS

SEQ ID NO: 189 - protein, 116 aa, Artificial Sequence
  Artificial polymer
QVQLKQSGPGLVQPSQSLSITCTVSGFSLTSYGVHWVRQSPGKGLEWLGVIWSGGVTDYNAAFISRLSISKDNSKSQVFFKMNSLQANDTAIYYCARLGFYAMDYWGQGTSVTVSS

SEQ ID NO: 190 - protein, 119 aa, Artificial Sequence
  Artificial polymer
EVKLFESGGGLVQPGGSLKLSCVASGFDFSTYWMHWVRQAPGQGLEWIGQINPDSTTINYAPSLKDRFIISRDNAKNTLFLQMSKVRSEDTALYYCAKPGDYGYDFDCWGQGTTLTVSS

SEQ ID NO: 191 - protein, 119 aa, Artificial Sequence
  Artificial polymer
EVQLQESGPSLVKPSQTLSLTCSVTGDSITSGYWNWIRKFPGNKLEYMGYISYSGSTYYNPSLKSRISITRDTSKNQYYLQLNSVTTEDTATYYCARSLLWFSTGFAYWGQGTLVTVSA

SEQ ID NO: 192 - protein, 116 aa, Artificial Sequence
  Artificial polymer
QVQLKQSGPGLVQPSQSLSITCTVSGFSLTSYGVHWVRQSPGKGLEWLGVIWSGGITDYNAAFKSRLSISKDNSKSQVFFKMNSLQANDTAIYFCARLGFYAMDYWGQGTSVTVSS

SEQ ID NO: 193 - protein, 116 aa, Artificial Sequence
  Artificial polymer
EVKLVESGGGLVKPGGSLKLSCAASGFTFRSYGMSWARQIPEKRLEWVASISSGGTTYYLGSVQGRFTISRDNARNILYLQMSSLRSEDTAMYYCARGYDAGFAYWGQGTLVSVSE

SEQ ID NO: 194 - protein, 117 aa, Artificial Sequence
  Artificial polymer
EVQLQESGPSLVKPSQTLSLTCSVTGDSITSGYWTWIRKFPGNKLEYMGYISYTGSTYYNPSLKSRISISRDTSKSQYYLQLNSVTTEDTATYYCARQRDWLGFAYWGQGTLVTVSA

SEQ ID NO: 195 - protein, 116 aa, Artificial Sequence
  Artificial polymer
EEKLVESGGGLVKPGGSLKLSCAASGFSFSSYGMSWVRQTPEKRLEWVASISSGGSIYYPDSVKGRFTISRDNARNILYLQMSSLRSEDTAMYYCARGYDAGFAFWGQGTLVTASA

SEQ ID NO: 196 - protein, 116 aa, Artificial Sequence
  Artificial polymer
QITLKESGPTLVKPTQTLTLTCTVSGFSLSTYGVHWIRQPPGKALEWLGVIWRGVTTDYNAAFMSRLTITKDNSKNQVVLTMNNMDPVDTATYYCARLGFYAMDYWGQGTLVTVSS

SEQ ID NO: 197 - protein, 116 aa, Artificial Sequence
  Artificial polymer
EVQLVESGGGLVKPGGSLRLSCAASGFIFRSYGMSWVRQAPGKGLEWVASISSGGSTYYPDSVKGRFTISRDNAKNSLYLQMNSLRAEDTAVYDCARGYDSGFAYWGQGTLVTVSS

SEQ ID NO: 198 - protein, 112 aa, Artificial Sequence
  Artificial polymer
DIVLTQSPASLAVSLGQRATISCRASQSVSTSSSSFMHWYQQKPGQPPKLLIKYASNLESGVPARFSGSGSGTDFTLNIHPVEEEDTATYYCQHSWEIPYTFGGGTKLEIKR

SEQ ID NO: 199 - protein, 111 aa, Artificial Sequence
  Artificial polymer
DIVLTQSPPSLAVSLGQRATISCRASQSVSTSSSSYMHWYQQKPGQPPKLLIKYASNLESGVPARFSGSGSGTDFTLNIHPVEEEDTATYYCQHSWEIPYTFGGGTKLEIK

SEQ ID NO: 200 - protein, 107 aa, Artificial Sequence
  Artificial polymer
SIVMTQTPKFLLVSAGDRVTITCKASQSVSNDVAWYQQKPGQSPKLLIYYAANRYTGVPDRFTGSGYGTDFTFTISIVQAEDLAVYFCQQDYTSPYTFGGGTKLEIK

SEQ ID NO: 201 - protein, 107 aa, Artificial Sequence
  Artificial polymer
SIVMTQTPKFLLVSAGDRVTITCKASQSVSNDVGWYQQKPGQSPKLLIYYASNRYSGVPDRFTGSGYGTDFTFTISTVQAEDLAVYFCQQDYTSPYTFGGGTKLEIK

SEQ ID NO: 202 - protein, 112 aa, Artificial Sequence
  Artificial polymer
DVLMTQTPLYLPVSLGDQASISCRSSQIIVHSNANTYLEWFLQKPGQSPKLLIYKVSNRFSGVPDRFSGSGSGTDFTLKISRVEAEDLGVYYCFQGSHVPYTFGGGTKLEIK

SEQ ID NO: 203 - protein, 108 aa, Artificial Sequence
  Artificial polymer
QIVLTQSPAIMSASPGEKVTLTCSASSSVSSSYLYWNQQKPGSSPKVWIYNTSNLASGVPARFSGSGSGTSYSLTISSMEAEDAASYFCHQWRSYPPTLGAGTKLELK

SEQ ID NO: 204 - protein, 106 aa, Artificial Sequence
  Artificial polymer
QIVLTQSPAIMSASPGEKVTMTCSANSSVSYMHWYQQKSGTSPKRWIYDTSKLASGVPARFSGSGSGTSYSLTISSMGAEDAATYYCQQWSSNPWTFGGGTKLEIK

SEQ ID NO: 205 - protein, 111 aa, Artificial Sequence
  Artificial polymer
DIVLTQSPASLAVSLGQRATISCRASQSVSTSSYSYMHWYQQKPGQPPKLLIKYASNLESGVPARFSGSGSGTDFTLNIHPVEEEDTATYYCQNSWEIPYTFGGGTKLEIK

SEQ ID NO: 206 - protein, 113 aa, Artificial Sequence
  Artificial polymer
DIVMTQTPSSLAVSLGEKVTMSCKSSQSLLYSSNQKNSLAWYQQKPGQSPKLLIYWASNRESGVPDRFTGSSSGTDFTLTISSVKAEDLAVYYCQQYYSYPLTFGAGTKLELK

SEQ ID NO: 207 - protein, 111 aa, Artificial Sequence
  Artificial polymer
DIVLTQSPASLAVSLGQRATISCRASQSVSTSSYSYVHWYQQKPGQPPKLLIKYASNLESGVPARFSGSGSGTDFTLNIHPVEEEDTATYYCQHSWEIPYTFGGGTKLEIK

SEQ ID NO: 208 - protein, 107 aa, Artificial Sequence
  Artificial polymer
DIQMTQSPSSLSASVGDRVTITCKASQSVSNDVAWYQQKPGKAPKLLIYYAANRYTGVPDRFSGSGYGTDFTFTISSLQPEDIATYFCQQDYTSPYTFGQGTKLEIK

SEQ ID NO: 209 - protein, 111 aa, Artificial Sequence
  Artificial polymer
DIVLTQSPASLAVSPGQRATITCRASQSVSTSSSSFMHWYQQKPGQPPKLLIKYASNLESGVPARFSGSGSGTDFTLTINPVEANDTANYYCQHSWEIPYTFGQGTKLEIK

SEQ ID NO: 210 - protein, 117 aa, Artificial Sequence
  Artificial polymer
EVQLVQSGAEVKKPGESLRISCKGSGYTFTTYWMHWVRQATGQGLEWMGNIYPGTGGSNFDEKFKNRVTITADKSTSTAYMELSSLRSEDTAVYYCTRWTTGTGAYWGQGTTVTVSS

SEQ ID NO: 211 - protein, 117 aa, Artificial Sequence
  Artificial polymer
EVQLVQSGAEVKKPGESLRISCKGSGYTFTTYWMHWIRQSPSRGLEWLGNIYPGTGGSNFDEKFKNRFTISRDNSKNTLYLQMNSLRAEDTAVYYCTRWTTGTGAYWGQGTTVTVSS

SEQ ID NO: 212 - protein, 117 aa, Artificial Sequence
  Artificial polymer
QVQLVQSGAEVKKPGASVKVSCKASGYTFTTYWMHWIRQSPSRGLEWLGNIYPGTGGSNFDEKFKNRFTISRDNSKNTLYLQMNSLRAEDTAVYYCTRWTTGTGAYWGQGTTVTVSS

SEQ ID NO: 213 - protein, 117 aa, Artificial Sequence
  Artificial polymer
EVQLVQSGAEVKKPGESLRISCKGSGYTFTTYWMHWVRQAPGQGLEWMGNIYPGTGGSNFDEKFKNRFTISRDNSKNTLYLQMNSLRAEDTAVYYCTRWTTGTGAYWGQGTTVTVSS

SEQ ID NO: 214 - protein, 113 aa, Artificial Sequence
  Artificial polymer
EIVLTQSPATLSLSPGERATLSCKSSQSLLDSGNQKNFLTWYQQKPGQAPRLLIYWASTRESGVPSRFSGSGSGTEFTLTISSLQPDDFATYYCQNDYSYPYTFGQGTKVEIK

SEQ ID NO: 215 - protein, 113 aa, Artificial Sequence
  Artificial polymer
DIQMTQSPSSLSASVGDRVTITCKSSQSLLDSGNQKNFLTWYQQKPGQAPRLLIYWASTRESGIPPRFSGSGYGTDFTLTINNIESEDAAYYFCQNDYSYPYTFGQGTKVEIK

SEQ ID NO: 216 - protein, 113 aa, Artificial Sequence
  Artificial polymer
EIVLTQSPATLSLSPGERATLSCKSSQSLLDSGNQKNFLTWYQQKPGKAPKLLIYWASTRESGVPSRFSGSGSGTDFTFTISSLQPEDIATYYCQNDYSYPYTFGQGTKVEIK

SEQ ID NO: 217 - protein, 113 aa, Artificial Sequence
  Artificial polymer
DIVMTQTPLSLPVTPGEPASISCKSSQSLLDSGNQKNFLTWYQQKPGQAPRLLIYWASTRESGVPSRFSGSGSGTDFTFTISSLEAEDAATYYCQNDYSYPYTFGQGTKVEIK

SEQ ID NO: 218 - protein, 113 aa, Artificial Sequence
  Artificial polymer
EIVLTQSPATLSLSPGERATLSCKSSQSLLDSGNQKNFLTWYQQKPGKAPKLLIYWASTRESGVPSRFSGSGSGTDFTFTISSLEAEDAATYYCQNDYSYPYTFGQGTKVEIK

SEQ ID NO: 219 - protein, 113 aa, Artificial Sequence
  Artificial polymer
EIVLTQSPDFQSVTPKEKVTITCKSSQSLLDSGNQKNFLTWYQQKPGQAPRLLIYWASTRESGVPSRFSGSGSGTDFTFTISSLEAEDAATYYCQNDYSYPYTFGQGTKVEIK

SEQ ID NO: 220 - protein, 113 aa, Artificial Sequence
  Artificial polymer
EIVLTQSPATLSLSPGERATLSCKSSQSLLDSGNQKNFLTWYQQKPGQAPRLLIYWASTRESGVPSRFSGSGSGTDFTFTISSLEAEDAATYYCQNDYSYPYTFGQGTKVEIK

SEQ ID NO: 221 - protein, 113 aa, Artificial Sequence
  Artificial polymer
DIQMTQSPSSLSASVGDRVTITCKSSQSLLDSGNQKNFLTWYLQKPGQSPQLLIYWASTRESGVPSRFSGSGSGTDFTFTISSLEAEDAATYYCQNDYSYPYTFGQGTKVEIK

SEQ ID NO: 222 - protein, 113 aa, Artificial Sequence
  Artificial polymer
DVVMTQSPLSLPVTLGQPASISCKSSQSLLDSGNQKNFLTWYQQKPGKAPKLLIYWASTRESGVPSRFSGSGSGTDFTFTISSLEAEDAATYYCQNDYSYPYTFGQGTKVEIK

SEQ ID NO: 223 - protein, 118 aa, Artificial Sequence
  Artificial polymer
EVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSA

SEQ ID NO: 224 - protein, 108 aa, Artificial Sequence
  Artificial polymer
DIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIKR

SEQ ID NO: 225 - protein, 126 aa, Artificial Sequence
  Artificial polymer
EVQLVESGGGLVQPGGSLRLSCAASGFTLDYYAIGWFRQAPGKEREWASSISSSDGSTYYADSVKGRFTISRDNAKNTVFLQMNSLKPEDTAVYSCAASQAPITIATMMKPFYDYWGQGTQVTVSS

SEQ ID NO: 226 - protein, 123 aa, Artificial Sequence
  Artificial polymer
EVQLVESGGGLVQPGGSLRLSCAASGFTLDYYAKCWFRQAPGKEREWVSCISSSDGSTYYADSVKGRFTISRDNAKNTVYLQMNSLKPEDTAVYFCAARHGGPLTVEYFFDYWGQGTQVTVSS

SEQ ID NO: 227 - protein, 124 aa, Artificial Sequence
  Artificial polymer
EVQLVESGGGLVQPGGSLRLSCAASGFTFDYYAIGWFRQAPGKAREGVSCISGGDNSTYYADSVKGRFTISRDNAKNTVYLQMNSLKPEDTAVYYCATGGWKYCSGYDPEYIYWGQGTQVTVSS

SEQ ID NO: 228 - protein, 115 aa, Artificial Sequence
  Artificial polymer
EVQLVESGGGLVQAGGSLRLSCAASGSTFSQYDVGWYRQAPGKQRELVAFSSSGGRTIYPDSVKGRFTFSRDNTKNTVYLQMTSLKPEDTAVYYCKIDWYLNSYWGQGTQVTVSS

SEQ ID NO: 229 - protein, 114 aa, Artificial Sequence
  Artificial polymer
EVQLVESGGGLVQAGGSLRLSCAASGVDASNSAMGWYRQAPGKQREWVARITGGGLIAYTDSVKGRFTISRDNAKSTVYLQMNSLEPEDTAVYYCNTINSRDGWGQGTQVTVSS

SEQ ID NO: 230 - protein, 111 aa, Artificial Sequence
  Artificial polymer
EVQLVESGGGLVQAGGSLTISCAASGITFSDSIVSWYRRARGKQREWVAGISNGGTTKYAESVLGRFTISRDNAKNNVYLQMNGLNPEDTAVYLCKVRQYWGQGTQVTVSS

SEQ ID NO: 231 - protein, 130 aa, Artificial Sequence
  Artificial polymer
EVQLVESGGGLVQAGGSLRLSCAASESTVLINAMGWYRQAPGKQRELVASISSGGSTNYADSVKGRFTISRDNAKNTVYLQMNSLKPEDTAVYYCNADVYPQDYGLGYVEGKVYYGHDYWGTGTLVTVSS

SEQ ID NO: 232 - protein, 119 aa, Artificial Sequence
  Artificial polymer
EVQLVESGGGLVQAGGSLRLSCAASGSTFSNYVSNYAMGWGRQAPGTQRELVASISNGDTTNYADSVKGRFTISRDNAKNTVYLQMNSLKPEDTAVYYCFEHQVAGLTWGQGTQVTVSS

SEQ ID NO: 233 - protein, 118 aa, Artificial Sequence
  Artificial polymer
  misc_feature (27)..(27): Xaa can be any naturally occurring amino acid
  misc_feature (32)..(32): Xaa can be any naturally occurring amino acid
  misc_feature (75)..(75): Xaa can be any naturally occurring amino acid
EVQLVESGGGLVQAGGSLRLSCVASGXALKIXVMGWYRQAPGKQRELVAAITSGGRTNYSDSVKGRFTISGDNAXNTVYLQMNSLKSEDTAVYYCREWNSGYPPVDYWGQGTQVTVSS

SEQ ID NO: 234 - protein, 120 aa, Artificial Sequence
  Artificial polymer
EVQLVESGGGLVQAGGSLRLSCAASGRTFSSGTMGWFRRAPGKEREFVASIPWSGGRTYYADSVKDRFTISRDNAQNTVFLQMNSLKPEDTAVYYCAFKERSTGWDFASWGQGIQVTVSS

SEQ ID NO: 235 - protein, 127 aa, Artificial Sequence
  Artificial polymer
EVQLVESGGGLVQTGGSLRLSCAASGFTLDYYGIGWFRQAPGKEREGVSFISGSDGSTYYAESVKGRFTISRDKAKNTVYLQMNSLKPEDTAVYYCAADPWGPPSIATMTSYEYKHWGQGTQVTVSS

SEQ ID NO: 236 - protein, 113 aa, Artificial Sequence
  Artificial polymer
EVQLVESGGGLVQPGGSLRLSCAASGFTFSTYTMIWLRRAPGKGFEWVSTIDKDGNTNYVDSVKGRFAVSRDNTKNTLYLQMNSLKPEDTAMYYCTKHGSSARGQGTRVTVSS

SEQ ID NO: 237 - protein, 114 aa, Artificial Sequence
  Artificial polymer
EVQLVESGGGLVEPGGSLRLSCVASGFTFSSYDMSWVRQAPGKGLEWVSTINSGGGITYRGSVKGRFTISRDNAKNTLYLQMNSLKPEDTAVYYCENGGSSYRRGQGTQVTVSS

SEQ ID NO: 238 - protein, 114 aa, Artificial Sequence
  Artificial polymer
QVQLVQSGAELKKPGASVKMSCKASGYTFTGYTMHWVKQAPGQGLEWIGYINPRSGYTEYNQKFKDRTTLTADKSTSTAYMELSSLRSEDSAVYYCARPWFAYWGQGTLVTVSS

SEQ ID NO: 239 - protein, 114 aa, Artificial Sequence
  Artificial polymer
QVQLVQSGAEVKKPGASVKMSCKASGYTFTGYTMHWVKQAPGQGLEWIGYINPRSGYTEYNQKFKDRTTLTADKSTSTAYMELSSLRSEDTAVYYCARPWFAYWGQGTLVTVSS

SEQ ID NO: 240 - protein, 114 aa, Artificial Sequence
  Artificial polymer
QVQLVQSGAEVKKPGASVKMSCKASGYTFTGYTMHWVRQAPGQGLEWIGYINPRSGYTEYNQKFKDRTTLTADKSTSTAYMELSSLRSEDTAVYYCARPWFAYWGQGTLVTVSS

SEQ ID NO: 241 - protein, 114 aa, Artificial Sequence
  Artificial polymer
QVQLVQSGAEVKKPGASVKVSCKASGYTFTGYTMHWVRQAPGQGLEWIGYINPRSGYTEYNQKFKDRTTLTADKSTSTAYMELSSLRSEDTAVYYCARPWFAYWGQGTLVTVSS

SEQ ID NO: 242 - protein, 114 aa, Artificial Sequence
  Artificial polymer
QVQLVQSGAEVKKPGASVKVSCKASGYTFTGYTMHWVRQAPGQGLEWIGYINPRSGYTEYNQKFKDRTTITADKSTSTAYMELSSLRSEDTAVYYCARPWFAYWGQGTLVTVSS

SEQ ID NO: 243 - protein, 113 aa, Artificial Sequence
  Artificial polymer
DIVMTQSPASLTVTPGEKVTITCKSSQSLLNSGNQKNYLTWYQQKPGQPPKLLIYWASTRESGVPDRFTGSGSGTDFTLTISSLQAEDVAVYYCQNDYSYPLTFGQGTKLEIK

SEQ ID NO: 244 - protein, 113 aa, Artificial Sequence
  Artificial polymer
DIVMTQSPASLSVTPGEKVTITCKSSQSLLNSGNQKNYLTWYQQKPGQPPKLLIYWASTRESGVPDRFTGSGSGTDFTLTISSLQAEDVAVYYCQNDYSYPLTFGQGTKLEIK

SEQ ID NO: 245 - protein, 113 aa, Artificial Sequence
  Artificial polymer
DIVMTQSPAFLSVTPGEKVTITCKSSQSLLNSGNQKNYLTWYQQKPGQPPKLLIYWASTRESGVPDRFTGSGSGTDFTLTISSLQAEDVAVYYCQNDYSYPLTFGQGTKLEIK

SEQ ID NO: 246 - protein, 113 aa, Artificial Sequence
  Artificial polymer
DIVMTQSPAFLSVTPGEKVTITCKSSQSLLNSGNQKNYLTWYQQKPGQPPKLLIYWASTRESGVPDRFSGSGSGTDFTLTISSLQAEDVAVYYCQNDYSYPLTFGQGTKLEIK

SEQ ID NO: 247 - protein, 5 aa, Artificial Sequence
  Artificial polymer
GGGGS

SEQ ID NO: 248 - protein, 10 aa, Artificial Sequence
  Artificial polymer
GGGGSGGGGS

SEQ ID NO: 249 - protein, 15 aa, Artificial Sequence
  Artificial polymer
GGGGSGGGGSGGGGS

SEQ ID NO: 250 - protein, 20 aa, Artificial Sequence
  Artificial polymer
GGGGSGGGGSGGGGSGGGGS

SEQ ID NO: 251 - protein, 25 aa, Artificial Sequence
  Artificial polymer
GGGGSGGGGSGGGGSGGGGSGGGGS

SEQ ID NO: 252 - protein, 30 aa, Artificial Sequence
  Artificial polymer
GGGGSGGGGSGGGGSGGGGSGGGGSGGGGS

SEQ ID NO: 253 - protein, 35 aa, Artificial Sequence
  Artificial polymer
GGGGSGGGGSGGGGSGGGGSGGGGSGGGGSGGGGS

SEQ ID NO: 254 - protein, 40 aa, Artificial Sequence
  Artificial polymer
GGGGSGGGGSGGGGSGGGGSGGGGSGGGGSGGGGSGGGGS

SEQ ID NO: 255 - protein, 16 aa, Artificial Sequence
  Artificial polymer
GGSGGSGGGGSGGGGS

SEQ ID NO: 256 - protein, 8 aa, Artificial Sequence
  Artificial polymer
GGGGGGGG

SEQ ID NO: 257 - protein, 6 aa, Artificial Sequence
  Artificial polymer
GGGGGG

SEQ ID NO: 258 - protein, 5 aa, Artificial Sequence
  Artificial polymer
EAAAK

SEQ ID NO: 259 - protein, 10 aa, Artificial Sequence
  Artificial polymer
EAAAKEAAAK

SEQ ID NO: 260 - protein, 15 aa, Artificial Sequence
  Artificial polymer
EAAAKEAAAKEAAAK

SEQ ID NO: 261 - protein, 12 aa, Artificial Sequence
  Artificial polymer
AEAAAKEAAAKA

SEQ ID NO: 262 - protein, 17 aa, Artificial Sequence
  Artificial polymer
AEAAAKEAAAKEAAAKA

SEQ ID NO: 263 - protein, 22 aa, Artificial Sequence
  Artificial polymer
AEAAAKEAAAKEAAAKEAAAKA

SEQ ID NO: 264 - protein, 27 aa, Artificial Sequence
  Artificial polymer
AEAAAKEAAAKEAAAKEAAAKEAAAKA

SEQ ID NO: 265 - protein, 46 aa, Artificial Sequence
  Artificial polymer
AEAAAKEAAAKEAAAKEAAAKALEAEAAAKEAAAKEAAAKEAAAKA

SEQ ID NO: 266 - protein, 5 aa, Artificial Sequence
  Artificial polymer
PAPAP

SEQ ID NO: 267 - protein, 18 aa, Artificial Sequence
  Artificial polymer
KESGSVSSEQLAQFRSLD

SEQ ID NO: 268 - protein, 14 aa, Artificial Sequence
  Artificial polymer
EGKSSGSGSESKST

SEQ ID NO: 269 - protein, 12 aa, Artificial Sequence
  Artificial polymer
GSAGSAAGSGEF

SEQ ID NO: 270 - protein, 5 aa, Artificial Sequence
  Artificial polymer
GGGSE

SEQ ID NO: 271 - protein, 5 aa, Artificial Sequence
  Artificial polymer
GSESG

SEQ ID NO: 272 - protein, 5 aa, Artificial Sequence
  Artificial polymer
GSEGS

SEQ ID NO: 273 - protein, 35 aa, Artificial Sequence
  Artificial polymer
GEGGSGEGSSGEGSSSEGGGSEGGGSEGGGSEGGS

SEQ ID NO: 274 - protein, 4 aa, Artificial Sequence
  Artificial polymer
CPPC

SEQ ID NO: 275 - protein, 6 aa, Artificial Sequence
  Artificial polymer
EEFGNQ

SEQ ID NO: 276 - protein, 7 aa, Artificial Sequence
  Artificial polymer
EEFDGNQ

SEQ ID NO: 277 - protein, 10 aa, Artificial Sequence
  Artificial polymer
GRTFSSLDMG

SEQ ID NO: 278 - protein, 5 aa, Artificial Sequence
  Artificial polymer
SLDMG

SEQ ID NO: 279 - protein, 10 aa, Artificial Sequence
  Artificial polymer
GFTFGGYDMG

SEQ ID NO: 280 - protein, 5 aa, Artificial Sequence
  Artificial polymer
GYDMG

SEQ ID NO: 281 - protein, 10 aa, Artificial Sequence
  Artificial polymer
GRTSSSLDMG

SEQ ID NO: 282 - protein, 10 aa, Artificial Sequence
  Artificial polymer
GHTFSSLDMG

SEQ ID NO: 283 - protein, 10 aa, Artificial Sequence
  Artificial polymer
ERTFSSLDMG

SEQ ID NO: 284 - protein, 10 aa, Artificial Sequence
  Artificial polymer
GRAFSSLDMG

SEQ ID NO: 285 - protein, 10 aa, Artificial Sequence
  Artificial polymer
GLNFRRYTMG

SEQ ID NO: 286 - protein, 5 aa, Artificial Sequence
  Artificial polymer
RYTMG

SEQ ID NO: 287 - protein, 10 aa, Artificial Sequence
  Artificial polymer
GISRSGISQY

SEQ ID NO: 288 - protein, 17 aa, Artificial Sequence
  Artificial polymer
GISRSGISQYYADSMKG

SEQ ID NO: 289 - protein, 17 aa, Artificial Sequence
  Artificial polymer
GISRSGISQYYADSMRG

SEQ ID NO: 290 - protein, 10 aa, Artificial Sequence
  Artificial polymer
GISRTGISAY

SEQ ID NO: 291 - protein, 17 aa, Artificial Sequence
  Artificial polymer
GISRTGISAYYADSMKG

SEQ ID NO: 292 - protein, 17 aa, Artificial Sequence
  Artificial polymer
GISRSGISQYYANSMKG

SEQ ID NO: 293 - protein, 10 aa, Artificial Sequence
  Artificial polymer
GVSRSGISQY

SEQ ID NO: 294 - protein, 17 aa, Artificial Sequence
  Artificial polymer
GVSRSGISQYYADSMKG

SEQ ID NO: 295 - protein, 10 aa, Artificial Sequence
  Artificial polymer
VINWSDDSIY

SEQ ID NO: 296 - protein, 17 aa, Artificial Sequence
  Artificial polymer
VINWSDDSIYYADSVKG

SEQ ID NO: 297 - protein, 15 aa, Artificial Sequence
  Artificial polymer
ALTFRGSDLPRDSNY

SEQ ID NO: 298 - protein, 15 aa, Artificial Sequence
  Artificial polymer
ALTFRGSNLPRDSNY

SEQ ID NO: 299 - protein, 18 aa, Artificial Sequence
  Artificial polymer
SPQWDTRVRQTMRGKYDY

SEQ ID NO: 300 - protein, 143 aa, Artificial Sequence
  Artificial polymer
QVQLQESGGGVVQAGDSLRLSCVASGRTFSSLDMGWFRQAPGKEREFVAGISRSGISQYYADSMKGRFTISRDNAKNLVYLQMNSLKPEDTAVYYCAAALTFRGSDLPRDSNYWGQGTQVTVSSAAAYPYDVPDYGSHHHHHH

SEQ ID NO: 301 - protein, 143 aa, Artificial Sequence
  Artificial polymer
QVQLQESGGGVVQAGDSLKLSCVASGRTFSSLDMGWFRQAPGKEREFVAGISRSGISQYYADSMKGRFTISRDNAKNLVYLQMNSLKPEDTAVYYCAAALTFRGSDLPRDSNYWGQGTQVTVSSAAAYPYDVPDYGSHHHHHH

SEQ ID NO: 302 - protein, 143 aa, Artificial Sequence
  Artificial polymer
QVQLQESGGGVVQAGDSLRLSCVASGRTFSSLDMGWFRQTPGKEREFVAGISRSGISQYYADSMKGRFTISRDNAKNLVYLQMNSLKPEDTAVYYCAAALTFRGSDLPRDSNYWGQGTQVTVSSAAAYPYDVPDYGSHHHHHH

SEQ ID NO: 303 - protein, 143 aa, Artificial Sequence
  Artificial polymer
  misc_feature (46)..(46): Xaa can be any naturally occurring amino acid
QVQLQESGGGLVQPGDSLRLSCVASGRTFSSLDMGWFRQAPGKERXFVAGISRSGISQYYADSMKGRFTISRDNAKNLVYLQMNSLKPEDTAVYYCAAALTFRGSDLPRDSNYWGQGTQVTVSSAAAYPYDVPDYGSHHHHHH

SEQ ID NO: 304 - protein, 143 aa, Artificial Sequence
  Artificial polymer
QVQLQESGGGVVQAGDSLRLSCVASGRTFSSLDMGWFRQAPGKEREFVAGISRSGISQYYADSMRGRFTISRDNAKNLVYLQMNSLKPEDTAVYYCAAALTFRGSDLPRDSNYWGQGTQVTVSSAAAYPYDVPDYGSHHHHHH

SEQ ID NO: 305 - protein, 143 aa, Artificial Sequence
  Artificial polymer
QVQLQESGGGVVQAGDSLRLSCVASGRTFSSLDMGWFRQAPGKEREFVAGISRTGISAYYADSMKGRFTISRDNAKNLVYLQMNSLKSEDTAVYYCAAALTFRGSDLPRDSNYWGQGTQVTVSSAAAYPYDVPDYGSHHHHHH

SEQ ID NO: 306 - protein, 143 aa, Artificial Sequence
  Artificial polymer
QVQLQESGGGLVQPGGSLRLSCAASGFTFGGYDMGWFRQAPGKEREFVAGISRSGISQYYADSMKGRFTISRDNAKNLVYLQMNSLKPEDTAVYYCAAALTFRGSDLPRDSNYWGQGTQVTVSSAAAYPYDVPDYGSHHHHHH

SEQ ID NO: 307 - protein, 143 aa, Artificial Sequence
  Artificial polymer
QVQLQESGGGVVQAGDSLRLSCVASGRTFSSLDMGWFRQAPGKEREFVAGISRSGISQYYADSMKGRFTISRDNAKSLVYLQMNSLKPEDTAVYYCAAALTFRGSDLPRDSNYWGQGTQVTVSSAAAYPYDVPDYGSHHHHHH

SEQ ID NO: 308 - protein, 143 aa, Artificial Sequence
  Artificial polymer
QVQLQESGGGLVQAGGSLRLSCTASGRTFSSLDMGWFRQAPGKEREFVAGISRSGISQYYADSMKGRFTISRDNAKNLVYLQMNSLKPEDTAVYYCAAALTFRGSDLPRDSNYWGQGTQVTVSSAAAYPYDVPDYGSHHHHHH

SEQ ID NO: 309 - protein, 143 aa, Artificial Sequence
  Artificial polymer
QVQLQESGGGVVQTGDSLRLSCVASGRTFSSLDMGWFRQAPGKEREFVAGISRSGISQYYADSMKGRFTISRDNAKNLVYLQMNSLKPEDTAVYYCAAALTFRGSDLPRDSNYWGQGTQVTVSSAAAYPYDVPDYGSHHHHHH

SEQ ID NO: 310 - protein, 143 aa, Artificial Sequence
  Artificial polymer
QVQLQESGGGVVQAGDSLRLSCVASGRTFSSLDMGWFRQAPGKEREFVAGISRSGISQYYANSMKGRFTISRDNAKNLVYLQMNSLKPEDTAVYYCAAALTFRGSDLPRDSNYWGQGTQVTVSSAAAYPYDVPDYGSHHHHHH

SEQ ID NO: 311 - protein, 143 aa, Artificial Sequence
  Artificial polymer
QVQLQESGGGVVQAGDPLRLSCVASGRTFSSLDMGWFRQAPGKEREFVAGISRSGISQYYADSMKGRFTISRDNAKNLVYLQMNSLKPEDTAVYYCAAALTFRGSDLPRDSNYWGQGTQVTVSSAAAYPYDVPDYGSHHHHHH

SEQ ID NO: 312 - protein, 143 aa, Artificial Sequence
  Artificial polymer
QVQLQESGGGLVQAGGSLRLSCAASGRTFSSLDMGWFRQAPGKEREFVAGISRSGISQYYADSMKGRFTISRDNAKNLVYLQMNSLKPEDTAVYYCAAALTFRGSDLPRDSNYWGQGTQVTVSSAAAYPYDVPDYGSHHHHHH

SEQ ID NO: 313 - protein, 143 aa, Artificial Sequence
  Artificial polymer
QVQLQESGGGWVQPGGSLRLSCEASGRTSSSLDMGWFRQAPGKEREFVAGISRTGISAYYADSMKGRFTISRDNAKNLVYLQMNSLKSEDTAVYYCAAALTFRGSDLPRDSNYWGQGTQVTVSSAAAYPYDVPDYGSHHHHHH

SEQ ID NO: 314 - protein, 143 aa, Artificial Sequence
  Artificial polymer
QVQLQESGGGSVQAGGSLRLSCVASGRTFSSLDMGWFRQAPGKEREFVAGISRSGISQYYADSMKGRFTISRDNAKNLVYLQMNSLKPEDTAVYYCAAALTFRGSDLPRDSNYWGQGTQVTVSSAAAYPYDVPDYGSHHHHHH

SEQ ID NO: 315 - protein, 143 aa, Artificial Sequence
  Artificial polymer
QVQLQESGGGVVQAGDSLRLSCVASGRTFSSLDMGWFRQAPGKEREFVAGVSRSGISQYYADSMKGRFTISRDNAKNLVYLQMNSLKPEDTAVYYCAAALTFRGSDLPRDSNYWGQGTQVTVSSAAAYPYDVPDYGSHHHHHH

SEQ ID NO: 316 - protein, 143 aa, Artificial Sequence
  Artificial polymer
QVQLQESGGGLVQPGGSLRLSCAASGRTFSSLDMGWFRQAPGKEREFVAGISRSGISQYYADSMKGRFTISRDNAKNLVYLQINSLKPEDTAVYYCAAALTFRGSDLPRDSNYWGQGTQVTVSSAAAYPYDVPDYGSHHHHHH

SEQ ID NO: 317 - protein, 143 aa, Artificial Sequence
  Artificial polymer
QVQLQESGGGVVQAGDSLRLSCVASGHTFSSLDMGWFRQAPGKEREFVAGISRSGISQYYADSMKGRFTISRDNAKNLVYLQMNSLKPEDTAVYYCAAALTFRGSDLPRDSNYWGQGTQVTVSSAAAYPYDVPDYGSHHHHHH

SEQ ID NO: 318 - protein, 143 aa, Artificial Sequence
  Artificial polymer
QVQLQESGGGVVQAGDSLRLSCVASERTFSSLDMGWFRQAPGKEREFVAGISRSGISQYYADSMKGRFTISRDNAKNLVYLQMNSLKPEDTAVYYCAAALTFRGSNLPRDSNYWGQGTQVTVSSAAAYPYDVPDYGSHHHHHH

SEQ ID NO: 319 - protein, 143 aa, Artificial Sequence
  Artificial polymer
QVQLQESGGGVVQAGDSLRLSCVASERTFSSLDMGWFRQAPGKEREFVAGISRSGISQYYADSMKGRFTISRDNAKNLVYLQMNSLKPEDTAVYYCAAALTFRGSDLPRDSNYWGQGTQVTVSSAAAYPYDVPDYGSHHHHHH

SEQ ID NO: 320 - protein, 143 aa, Artificial Sequence
  Artificial polymer
QVQLQESGGGVVQAGDSLGLSCVASGRTFSSLDMGWFRQAPGKEREFVAGISRSGISQYYADSMKGRFTISRDNAKNLVYLQMNSLKPEDTAVYYCAAALTFRGSDLPRDSNYWGQGTQVTVSSAAAYPYDVPDYGSHHHHHH

SEQ ID NO: 321 - protein, 143 aa, Artificial Sequence
  Artificial polymer
QVQLQESGGGVVQAGDSLRLSCVASGRAFSSLDMGWFRQAPGKEREFVAGISRSGISQYYADSMKGRFTISRDNAKNLVYLQMNSLKPEDTAVYYCAAALTFRGSDLPRDSNYWGQGTQVTVSSAAAYPYDVPDYGSHHHHHH

SEQ ID NO: 322 - protein, 143 aa, Artificial Sequence
  Artificial polymer
QVQLQESGGGVVQAGDSLRLSCVASGRTFSSLDMGWFRQAPGKEREFVAGISRSGISQYYADSMKGRFTISRDNAKNLVYLQMNSLRPEDTAVYYCAAALTFRGSDLPRDSNYWGQGTQVTVSSAAAYPYDVPDYGSHHHHHH

SEQ ID NO: 323 - protein, 143 aa, Artificial Sequence
  Artificial polymer
QVQLQESGGGSVQAGDSLRLSCVASGRTFSSLDMGWFRQAPGKEREFVAGISRTGISAYYADSMKGRFTISRDNAKNLVYLQMNSLKSEDTAVYYCAAALTFRGSDLPRDSNYWGQGTQVTVSSAAAYPYDVPDYGSHHHHHH

SEQ ID NO: 324 - protein, 143 aa, Artificial Sequence
  Artificial polymer
QVQLQESGGGLVQSGDSLRLSCVASGRTFSSLDMGWFRQAPGKEREFVAGISRSGISQYYADSMKGRFTISRDNAKNLVYLQMNSLKPEDTAVYYCAAALTFRGSDLPRDSNYWGQGTQVTVSSAAAYPYDVPDYGSHHHHHH

SEQ ID NO: 325 - protein, 143 aa, Artificial Sequence
  Artificial polymer
QVQLQESGGGLVQAGDSLRLSCVASGRTFSSLDMGWFRQAPGKEREFVAGISRSGISQYYADSMKGRFTISRDNAKNLVYLQMNSLKPEDTAVYYCAAALTFRGSDLPRDSNYWGQGTQVTVSSAAAYPYDVPDYGSHHHHHH

SEQ ID NO: 326 - protein, 146 aa, Artificial Sequence
  Artificial polymer
QVQLQESGGGLVQPGGSLRLSCAASGLNFRRYTMGWFRQAPGKEREFVGVINWSDDSIYYADSVKGRFAISRDNTKNTVYLQMASLKPEDTAVYYCAASPQWDTRVRQTMRGKYDYWGQGTQVTVSSAAAYPYDVPDYGSHHHHHH

SEQ ID NO: 327 - protein, 6 aa, Artificial Sequence
  Artificial polymer
HHHHHH

SEQ ID NO: 328 - protein, 10 aa, Artificial Sequence
  Artificial polymer
YPYDVPDYGS

SEQ ID NO: 329 - protein, 19 aa, Artificial Sequence
  Artificial polymer
AAAYPYDVPDYGSHHHHHH

SEQ ID NO: 330 - protein, 166 aa, Artificial Sequence
  Artificial polymer
MKYTSYILAFQLCIVLGSLGCYCQDPYVKEAENLKKYFNAGHSDVADNGTLFLGILKNWKEESDRKIMQSQIVSFYFKLFKNFKDDQSIQKSVETIKEDMNVKFFNSNKKKRDDFEKLTNYSVTDLNVQRKAIHELIQVMAELSPAAKTGKRKRSQMLFRGRRASQ

SEQ ID NO: 331 - protein, 143 aa, Artificial Sequence
  Artificial polymer
QDPYVKEAENLKKYFNAGHSDVADNGTLFLGILKNWKEESDRKIMQSQIVSFYFKLFKNFKDDQSIQKSVETIKEDMNVKFFNSNKKKRDDFEKLTNYSVTDLNVQRKAIHELIQVMAELSPAAKTGKRKRSQMLFRGRRASQ

SEQ ID NO: 332 - protein, 288 aa, Artificial Sequence
  Artificial polymer
MQIPQAPWPVVWAVLQLGWRPGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQFQTLVVGVVGGLLGSLVLLVWVLAVICSRAARGTIGARRTGQPLKEDPSAVPVFSVDYGELDFQWREKTPEPPVPCVPEQTEYATIVFPSGMGTSSPARRGSADGPRSAQPLRPEDGHCSWPL

SEQ ID NO: 333 - protein, 10 aa, Artificial Sequence
  Artificial polymer
GFSMDYYAIA

SEQ ID NO: 334 - protein, 10 aa, Artificial Sequence
  Artificial polymer
GFSMDYYAIA

SEQ ID NO: 335 - protein, 10 aa, Artificial Sequence
  Artificial polymer
GFSVDYYAIA

SEQ ID NO: 336 - protein, 10 aa, Artificial Sequence
  Artificial polymer
GFSMDYYAIA

SEQ ID NO: 337 - protein, 10 aa, Artificial Sequence
  Artificial polymer
GGFNRVSYMG

SEQ ID NO: 338 - protein, 10 aa, Artificial Sequence
  Artificial polymer
GGFNRVSYMG

SEQ ID NO: 339 - protein, 10 aa, Artificial Sequence
  Artificial polymer
GIIKSINFMG

SEQ ID NO: 340 - protein, 10 aa, Artificial Sequence
  Artificial polymer
GFILDYYGIG

SEQ ID NO: 341 - protein, 10 aa, Artificial Sequence
  Artificial polymer
GLSLDYDGVG

SEQ ID NO: 342 - protein, 10 aa, Artificial Sequence
  Artificial polymer
GFILDYYGIG

SEQ ID NO: 343 - protein, 10 aa, Artificial Sequence
  Artificial polymer
GRTFSSLGMG

SEQ ID NO: 344 - protein, 10 aa, Artificial Sequence
  Artificial polymer
GRTFSSLGMG

SEQ ID NO: 345 - protein, 10 aa, Artificial Sequence
  Artificial polymer
GFAFGSYDMG

SEQ ID NO: 346 - protein, 10 aa, Artificial Sequence
  Artificial polymer
GFSFGNNDMS

SEQ ID NO: 347 - protein, 5 aa, Artificial Sequence
  Artificial polymer
IHAMG

SEQ ID NO: 348 - protein, 5 aa, Artificial Sequence
  Artificial polymer
INAMA

SEQ ID NO: 349 - protein, 5 aa, Artificial Sequence
  Artificial polymer
SGTMG

SEQ ID NO: 350 - protein, 9 aa, Artificial Sequence
  Artificial polymer
GSIASIHAM

SEQ ID NO: 351 - protein, 10 aa, Artificial Sequence
  Artificial polymer
GSIASIHAMG

SEQ ID NO: 352 - protein, 5 aa, Artificial Sequence
  Artificial polymer
FYGMG

SEQ ID NO: 353 - protein, 10 aa, Artificial Sequence
  Artificial polymer
GGTFSFYGMG

SEQ ID NO: 354 - protein, 5 aa, Artificial Sequence
  Artificial polymer
YYAIA

SEQ ID NO: 355 - protein, 5 aa, Artificial Sequence
  Artificial polymer
VSYMG

SEQ ID NO: 356 - protein, 5 aa, Artificial Sequence
  Artificial polymer
INFMG

SEQ ID NO: 357 - protein, 5 aa, Artificial Sequence
  Artificial polymer
SLGMG

SEQ ID NO: 358 - protein, 5 aa, Artificial Sequence
  Artificial polymer
SYDMG

SEQ ID NO: 359 - protein, 5 aa, Artificial Sequence
  Artificial polymer
NNDMS

SEQ ID NO: 360 - protein, 11 aa, Artificial Sequence
  Artificial polymer
CITGSDFMVDT

SEQ ID NO: 361 - protein, 11 aa, Artificial Sequence
  Artificial polymer
CITGSDFMVDT

SEQ ID NO: 362 - protein, 11 aa, Artificial Sequence
  Artificial polymer
CITGSDFMVDT

SEQ ID NO: 363 - protein, 11 aa, Artificial Sequence
  Artificial polymer
CITGSDFMVDT

SEQ ID NO: 364 - protein, 8 aa, Artificial Sequence
  Artificial polymer
SVTSGGEI

SEQ ID NO: 365 - protein, 8 aa, Artificial Sequence
  Artificial polymer
SVTSGGEI

SEQ ID NO: 366 - protein, 8 aa, Artificial Sequence
  Artificial polymer
STTSDGRT

SEQ ID NO: 367 - protein, 9 aa, Artificial Sequence
  Artificial polymer
CISSSDGST

SEQ ID NO: 368 - protein, 9 aa, Artificial Sequence
  Artificial polymer
CISSSDGST

SEQ ID NO: 369 - protein, 9 aa, Artificial Sequence
  Artificial polymer
CISSSDGST

SEQ ID NO: 370 - protein, 9 aa, Artificial Sequence
  Artificial polymer
AIAWNGAST

SEQ ID NO: 371 - protein, 9 aa, Artificial Sequence
  Artificial polymer
AIAWNGAST

SEQ ID NO: 372 - protein, 9 aa, Artificial Sequence
  Artificial polymer
GINSGGRIT

SEQ ID NO: 373 - protein, 9 aa, Artificial Sequence
  Artificial polymer
AINSGGGST

SEQ ID NO: 374 - protein, 17 aa, Artificial Sequence
  Artificial polymer
AITWSGGITYYEDSVKG

SEQ ID NO: 375 - protein, 17 aa, Artificial Sequence
  Artificial polymer
VITWSGGITYYADSVKG

SEQ ID NO: 376 - protein, 17 aa, Artificial Sequence
  Artificial polymer
VITVSGGITYYADSVKG

SEQ ID NO: 377 - protein, 17 aa, Artificial Sequence
  Artificial polymer
AITWSGGITYYADSLKG

SEQ ID NO: 378 - protein, 17 aa, Artificial Sequence
  Artificial polymer
LISWSGGSTYYEDSVKG

SEQ ID NO: 379 - protein, 17 aa, Artificial Sequence
  Artificial polymer
SIPWSGGRIYYADSVKG

SEQ ID NO: 380 - protein, 10 aa, Artificial Sequence
  Artificial polymer
VITWSGGITY

SEQ ID NO: 381 - protein, 10 aa, Artificial Sequence
  Artificial polymer
VITVSGGITY

SEQ ID NO: 382 - protein, 17 aa, Artificial Sequence
  Artificial polymer
DIRTSAGRTYYADSVKG

SEQ ID NO: 383 - protein, 10 aa, Artificial Sequence
  Artificial polymer
DIRTSAGRTY

SEQ ID NO: 384 - protein, 12 aa, Artificial Sequence
  Artificial polymer
CITGSDFMVDTY

SEQ ID NO: 385 - protein, 19 aa, Artificial Sequence
  Artificial polymer
CITGSDFMVDTYYVASVKG

SEQ ID NO: 386 - protein, 9 aa, Artificial Sequence
  Artificial polymer
SVTSGGEIT

SEQ ID NO: 387 - protein, 16 aa, Artificial Sequence
  Artificial polymer
SVTSGGEITIADSVKG

SEQ ID NO: 388 - protein, 16 aa, Artificial Sequence
  Artificial polymer
SVTSGGEITVADSVKG

SEQ ID NO: 389 - protein, 9 aa, Artificial Sequence
  Artificial polymer
STTSDGRTT

SEQ ID NO: 390 - protein, 16 aa, Artificial Sequence
  Artificial polymer
STTSDGRTTVADSVKG

SEQ ID NO: 391 - protein, 10 aa, Artificial Sequence
  Artificial polymer
CISSSDGSTY

SEQ ID NO: 392 - protein, 10 aa, Artificial Sequence
  Artificial polymer
AIAWNGASTY

SEQ ID NO: 393 - protein, 17 aa, Artificial Sequence
  Artificial polymer
AIAWNGASTYYTESVKG

SEQ ID NO: 394 - protein, 10 aa, Artificial Sequence
  Artificial polymer
GINSGGRITD

SEQ ID NO: 395 - protein, 17 aa, Artificial Sequence
  Artificial polymer
GINSGGRITDYADSVTG

SEQ ID NO: 396 - protein, 10 aa, Artificial Sequence
  Artificial polymer
AINSGGGSTY

SEQ ID NO: 397 - protein, 17 aa, Artificial Sequence
  Artificial polymer
AINSGGGSTYYADSVKG

SEQ ID NO: 398 - protein, 19 aa, Artificial Sequence
  Artificial polymer
AVRSTANTLCPSHYSVMDY

SEQ ID NO: 399 - protein, 19 aa, Artificial Sequence
  Artificial polymer
AVRSTANTLCPSHYSVMDY

SEQ ID NO: 400 - protein, 19 aa, Artificial Sequence
  Artificial polymer
AVRSTANTLCPSHYSIMDY

SEQ ID NO: 401 - protein, 19 aa, Artificial Sequence
  Artificial polymer
AVRSTANTLCPSHYSVMDY

SEQ ID NO: 402 - protein, 14 aa, Artificial Sequence
  Artificial polymer
NADIWVSDARMYNY

SEQ ID NO: 403 - protein, 14 aa, Artificial Sequence
  Artificial polymer
NADIWVSDARMYNY

SEQ ID NO: 404 - protein, 14 aa, Artificial Sequence
  Artificial polymer
NADIWLPSDRMYNY

SEQ ID NO: 405 - protein, 13 aa, Artificial Sequence
  Artificial polymer
ATATLCDGGIWGY

SEQ ID NO: 406 - protein, 13 aa, Artificial Sequence
  Artificial polymer
ATATLCDGGIWGY

SEQ ID NO: 407 - protein, 13 aa, Artificial Sequence
  Artificial polymer
ATATLCDGGIWGY

SEQ ID NO: 408 - protein, 17 aa, Artificial Sequence
  Artificial polymer
AASGLGSVVVTANEYDY

SEQ ID NO: 409 - protein, 17 aa, Artificial Sequence
  Artificial polymer
AASGLGSVVVTANEYDY

SEQ ID NO: 410 - protein, 15 aa, Artificial Sequence
  Artificial polymer
AQGDRSSWHYYGMDY

SEQ ID NO: 411 - protein, 13 aa, Artificial Sequence
  Artificial polymer
ATKSDPMTNEYDL

SEQ ID NO: 412 - protein, 10 aa, Artificial Sequence
  Artificial polymer
DRAESSWYDY

SEQ ID NO: 413 - protein, 10 aa, Artificial Sequence
  Artificial polymer
DKHQSSWYDY

SEQ ID NO: 414 - protein, 10 aa, Artificial Sequence
  Artificial polymer
DKHQSSFYDY

SEQ ID NO: 415 - protein, 10 aa, Artificial Sequence
  Artificial polymer
DRAQSSWYDY

SEQ ID NO: 416 - protein, 10 aa, Artificial Sequence
  Artificial polymer
DRVDSNWYDY

SEQ ID NO: 417 - protein, 11 aa, Artificial Sequence
  Artificial polymer
KERSTGWDFAS

SEQ ID NO: 418 - protein, 10 aa, Artificial Sequence
  Artificial polymer
EMSGISGWDY

SEQ ID NO: 419 - protein, 147 aa, Artificial Sequence
  Artificial polymer
QVQLQESGGGLVQPGGSLRLSCAASGFSMDYYAIAWFRQAPGKEREEISCITGSDFMVDTYYVASVKGRFTISRDNAENTAYLQMNNLKPEDTGVYFCAVRSTANTLCPSHYSVMDYWGKGTQVTVSSAAAYPYDVPDYGSHHHHHH

SEQ ID NO: 420 - protein, 147 aa, Artificial Sequence
  Artificial polymer
QVQLQESGGGLVQAGGSLRLSCAASGFSMDYYAIAWFRQAPGKEREEISCITGSDFMVDTYYVASVKGRFTISRDNAENTAYLQMNNLKPEDTGVYFCAVRSTANTLCPSHYSVMDYWGKGTQVTVSSAAAYPYDVPDYGSHHHHHH

SEQ ID NO: 421 - protein, 147 aa, Artificial Sequence
  Artificial polymer
QVQLQESGGGLVQPGGSLRLSCSASGFSVDYYAIAWFRQAPGKEREEISCITGSDFMVDTYYVASVKGRFTISRDNAKNTAYLQMNSLKPEDTGVYFCAVRSTANTLCPSHYSIMDYWGKGTQVTVSSAAAYPYDVPDYGSHHHHHH

SEQ ID NO: 422 - protein, 147 aa, Artificial Sequence
  Artificial polymer
QVQLQESGGGLVQPGGSLRLSCSASGFSMDYYAIAWFRQAPGKEREEISCITGSDFMVDTYYVASVKGRFTISRDNAKNTAHLQMNSLKPEDTGVYFCAVRSTANTLCPSHYSVMDYWGKGTQVTVSSAAAYPYDVPDYGSHHHHHH

SEQ ID NO: 423 - protein, 139 aa, Artificial Sequence
  Artificial polymer
QVQLQESGGGLVQAGGSLRLSCAASGGFNRVSYMGWYRQAPGTKRELVASVTSGGEITIADSVKGRFTVSRDNSKNTLYLQMNGLKPEDGATYWCNADIWVSDARMYNYWGQGTQVTVSSAAAYPYDVPDYGSHHHHHH

SEQ ID NO: 424 - protein, 139 aa, Artificial Sequence
  Artificial polymer
QVQLQESGGGLVQTGESLRLSCAASGGFNRVSYMGWYRQAPGSKRELVASVTSGGEITVADSVKGRFTVSRDNNKNTLYLQMNGLKPEDGATYWCNADIWVSDARMYNYWGQGTQVTVSSAAAYPYDVPDYGSHHHHHH

SEQ ID NO: 425 - protein, 139 aa, Artificial Sequence
  Artificial polymer
QVQLQESGGGLVQTGESLRLSCAASGIIKSINFMGWYRQPPGTKRELVASTTSDGRTTVADSVKGRFTISRDNAKNTIYLEMSSLKPEDTATYWCNADIWLPSDRMYNYWGQGTQVTVSSAAAYPYDVPDYGSHHHHHH

SEQ ID NO: 426 - protein, 139 aa, Artificial Sequence
  Artificial polymer
QVQLQESGGGLVQAGGSLRLSCAVSGFILDYYGIGWFRQAPGKEREAVSCISSSDGSTYYADSVKGRFTISRDNALNTLYLQMNSLKPEDTAVYHCATATLCDGGIWGYWGQGTQVTVSSAAAYPYDVPDYGSHHHHHH

SEQ ID NO: 427 - protein, 139 aa, Artificial Sequence
  Artificial polymer
QVQLQESGGGLAQAGGSLRLSCEGSGLSLDYDGVGWFRQAPGKEREAVSCISSSDGSTYYADSVKGRFTISRGNALNTLYLQMNSLKPEDTAVYYCATATLCDGGIWGYWGQGTQVTVSSAAAYPYDVPDYGSHHHHHH

SEQ ID NO: 428 - protein, 139 aa, Artificial Sequence
  Artificial polymer
QVQLQESGGGSVQPGGSLRLSCAVSGFILDYYGIGWFRQAPGKEREAVSCISSSDGSTYYADSVKGRFTISRDNALNTLYLQMNSLKPEDTAVYYCATATLCDGGIWGYWGQGTQVTVSSAAAYPYDVPDYGSHHHHHH

SEQ ID NO: 429 - protein, 143 aa, Artificial Sequence
  Artificial polymer
QVQLQESGGGSVQAGDSLRLSCTASGRTFSSLGMGWFRQAPGKEREFVSAIAWNGASTYYTESVKGRFTISRDDAKNTVYLQMNSLKPTDTAVYFCAASGLGSVVVTANEYDYWGQGTQVTVSSAAAYPYDVPDYGSHHHHHH

SEQ ID NO: 430 - protein, 143 aa, Artificial Sequence
  Artificial polymer
QVQLQESGGGSVQPGKSLRLSCAASGRTFSSLGMGWFRQAPGKEREFVSAIAWNGASTYYTESVKGRFTISRDDAKNTVYLQMNSLKPTDTAVYFCAASGLGSVVVTANEYDYWGQGTQVTVSSAAAYPYDVPDYGSHHHHHH

SEQ ID NO: 431 - protein, 141 aa, Artificial Sequence
  Artificial polymer
QVQLQESGGGLVQPGGSLRLSCTTSGFAFGSYDMGWVRQAPGKGPEWVSGINSGGRITDYADSVTGRFTISRDNAKNTLYLQMNSLKPEDTAVYYCAQGDRSSWHYYGMDYWGKGTQVTVSSAAAYPYDVPDYGSHHHHHH

SEQ ID NO: 432 - protein, 139 aa, Artificial Sequence
  Artificial polymer
  misc_feature (112)..(112): Xaa can be any naturally occurring amino acid
QVQLQESGGGLVQPGGSLRLSCAASGFSFGNNDMSWVRQAPGKGPEWVSAINSGGGSTYYADSVKGRFTISRDNAKNTLYLQMNSLKPEDTAVYYCATKSDPMTNEYDLWGXGTQVTVSSAAAYPYDVPDYGSHHHHHH

SEQ ID NO: 433 - protein, 119 aa, Artificial Sequence
  Artificial polymer
EVQLVESGGGLVQAGGSLRLSCAASGSIASIHAMGWFRQAPGKEREFVAVITWSGGITYYADSVKGRFTISRDNAKNTVYLQMNSLKPEDTAIYYCAGDKHQSSWYDYWGQGTLVTVSS

SEQ ID NO: 434 - protein, 119 aa, Artificial Sequence
  Artificial polymer
EVQLVESGGGLVQAGGSLRLSCAASGSIASIHAMGWFRQAPGKEREFVAVITWSGGITYYADSVKGRFTISRDNAKNTVYLQMNSLKPEDTATYYCAGDKHQSSWYDYWGQGTLVTVSS

SEQ ID NO: 435 - protein, 119 aa, Artificial Sequence
  Artificial polymer
EVQLVESGGGLVQAGGSLRLSCAASGSIASIHAMGWFRQAPGKEREFVAVITWSGGITYYADSVKGRFTISRDNAKNTVYLQMNSLKPEDTATYYCAGDKHQSSWYDYWGQGTLVKVSS

SEQ ID NO: 436 - protein, 119 aa, Artificial Sequence
  Artificial polymer
EVQLVESGGGVVQAGGSLRLSCAASGGTFSFYGMGWFRQAPGKEQEFVADIRTSAGRTYYADSVKGRFTISRDNAKNTVYLQMNSLKPEDTAVYYCAAEMSGISGWDYWGQGTQVQVSS

SEQ ID NO: 437 - protein, 119 aa, Artificial Sequence
  Artificial polymer
EVQLVESGGGVVQAGGSLRLSCAASGGTFSFYGMGWFRQAPGKEQEFVADIRTSAGRTYYADSVKGRFTISRDNAKNTVYLQMNSLKPEDTAVYYCAAEMSGISGWDYWGQGTLVTVKS

SEQ ID NO: 438 - protein, 119 aa, Artificial Sequence
  Artificial polymer
EVQLVESGGGVVQAGGSLRLSCAASGGTFSFYGMGWFRQAPGKEQEFVADIRTSAGRTYYADSVKGRFTISRDNAKNTVYLQMNSLKPEDTAVYYCAAEMSGISGWDYWGQGTLVTVQS

SEQ ID NO: 439 - protein, 119 aa, Artificial Sequence
  Artificial polymer
EVQLVESGGGLVQAGGSLRLSCAASGSIASIHAMGWFRQAPGKEQEFVADIRTSAGRTYYADSVKGRFTISRDNAKNTVYLQMNSLKPEDTALYYCAAEMSGISGWDYWGQGTLVKVSS

SEQ ID NO: 440 - protein, 119 aa, Artificial Sequence
  Artificial polymer
EVQLVESGGGLVQAGGSLRLSCAASGGTFSFYGMGWFRQAPGKEQEFVADIRTSAGRTYYADSVKGRFTISRDNAKNTVYLQMNSLKPEDTALYYCAAEMSGISGWDYWGQGTLVQVSS

SEQ ID NO: 441 - protein, 119 aa, Artificial Sequence
  Artificial polymer
EVQLVESGGGLVQAGGSLRLSCAASGGTFSFYGMGWFRQAPGKEQEFVADIRTSAGRTYYADSVKGRFTISRDNAKNTVYLQMNSLKPEDTALYYCAAEMSGISGWDYWGQGTLVTVKS

SEQ ID NO: 442 - protein, 119 aa, Artificial Sequence
  Artificial polymer
EVQLVESGGGVVQAGGSLRLSCAASGGTFSFYGMGWFRQAPGKEQEFVADIRTSAGRTYYADSVKGRFTISRDNAKNTVYLQMNSLKPEDTALYYCAAEMSGISGWDYWGQGTLVTVQS

SEQ ID NO: 443 - protein, 119 aa, Artificial Sequence
  Artificial polymer
EVQLVESGGGVVQAGGSLRLSCAASGGTFSFYGMGWFRQAPGKEQEFVADIRTSAGRTYYADSVKGRFTISRDNAKNTVYLQMNSLKPEDTALYYCAAEMSGISGWDYWGQGTLVTVSS

SEQ ID NO: 444 - protein, 119 aa, Artificial Sequence
  Artificial polymer
EVQLVESGGGVVQAGGSLRLSCAASGGTFSFYGMGWFRQAPGKEQEFVADIRTSAGRTYYADSVKGRFTISRDNAKNTVYLQMNSLKPEDTALYYCAAEMSGISGWDYWGQGTLVKVSS

SEQ ID NO: 445 - protein, 119 aa, Artificial Sequence
  Artificial polymer
EVQLVESGGGVVQAGGSLRLSCAASGGTFSFYGMGWFRQAPGKEQEFVADIRTSAGRTYYADSVKGRFTISRDNAKNTVYLQMNSLKPEDTALYYCAAEMSGISGWDYWGQGTLVQVSS

SEQ ID NO: 446 - protein, 119 aa, Artificial Sequence
  Artificial polymer
EVQLVESGGGVVQAGGSLRLSCAASGGTFSFYGMGWFRQAPGKEQEFVADIRTSAGRTYYADSVKGRFTISRDNAKNTVYLQMNSLKPEDTALYYCAAEMSGISGWDYWGQGTLVTVKS

SEQ ID NO: 447 - protein, 119 aa, Artificial Sequence
  Artificial polymer
EVQLVESGGGVVQPGGSLRLSCAASGGTFSFYGMGWFRQAPGKEQEFVADIRTSAGRTYYADSVKGRFTISRDNSKNTVYLQMNSLRPEDTALYYCAAEMSGISGWDYWGQGTLVTVQS

SEQ ID NO: 448 - protein, 119 aa, Artificial Sequence
  Artificial polymer
EVQLVESGGGVVQPGGSLRLSCAASGGTFSFYGMGWFRQAPGKEREFVADIRTSAGRTYYADSVKGRFTISRDNSKNTVYLQMNSLRPEDTALYYCAAEMSGISGWDYWGQGTLVTVSS

SEQ ID NO: 449 - protein, 119 aa, Artificial Sequence
  Artificial polymer
DVQLVESGGGVVQPGGSLRLSCAASGGTFSFYGMGWFRQAPGKEQEFVADIRTSAGRTYYADSVKGRFTISRDNSKNTVYLQMNSLRPEDTALYYCAAEMSGISGWDYWGQGTLVTVSS

SEQ ID NO: 450 - protein, 119 aa, Artificial Sequence
  Artificial polymer
DVQLVESGGGVVQPGGSLRLSCAASGGTFSFYGMGWFRQAPGKEREFVADIRTSAGRTYYADSVKGRFTISRDNSKNTVYLQMNSLRPEDTALYYCAAEMSGISGWDYWGQGTLVTSSA

SEQ ID NO: 451 - protein, 120 aa, Artificial Sequence
  Artificial polymer
EVQLVESGGGLVQAGGSLRLSCAASGGTFSFYGMGWFRQAPGKEQEFVADIRTSAGRTYYADSVKGRFTISRDNAKNTVYLQMNSLKPEDTATYYCAAEMSGISGWDYWGQGTLVKVSSA

SEQ ID NO: 452 - protein, 120 aa, Artificial Sequence
  Artificial polymer
EVQLVESGGGVVQAGGSLRLSCAASGGTFSFYGMGWFRQAPGKEQEFVADIRTSAGRTYYADSVKGRFTISRDNAKNTVYLQMNSLKPEDTAVYYCAAEMSGISGWDYWGQGTLVQVSSA

SEQ ID NO: 453 - protein, 120 aa, Artificial Sequence
  Artificial polymer
EVQLVESGGGVVQAGGSLRLSCAASGGTFSFYGMGWFRQAPGKEQEFVADIRTSAGRTYYADSVKGRFTISRDNAKNTVYLQMNSLKPEDTAVYYCAAEMSGISGWDYWGQGTLVTVKSA

SEQ ID NO: 454 - protein, 120 aa, Artificial Sequence
  Artificial polymer
EVQLVESGGGVVQAGGSLRLSCAASGGTFSFYGMGWFRQAPGKEQEFVADIRTSAGRTYYADSVKGRFTISRDNAKNTVYLQMNSLKPEDTAVYYCAAEMSGISGWDYWGQGTLVTVQSA

SEQ ID NO: 455 - protein, 120 aa, Artificial Sequence
  Artificial polymer
EVQLVESGGGVVQAGGSLRLSCAASGGTFSFYGMGWFRQAPGKEQEFVADIRTSAGRTYYADSVKGRFTISRDNAKNTVYLQMNSLKPEDTAVYYCAAEMSGISGWDYWGQGTLVKVSSA

SEQ ID NO: 456 - protein, 120 aa, Artificial Sequence
  Artificial polymer
EVQLVESGGGLVQAGGSLRLSCAASGGTFSFYGMGWFRQAPGKEQEFVADIRTSAGRTYYADSVKGRFTISRDNAKNTVYLQMNSLKPEDTALYYCAAEMSGISGWDYWGQGTLVQVSSA

SEQ ID NO: 457 - protein, 120 aa, Artificial Sequence
  Artificial polymer
EVQLVESGGGLVQAGGSLRLSCAASGGTFSFYGMGWFRQAPGKEQEFVADIRTSAGRTYYADSVKGRFTISRDNAKNTVYLQMNSLKPEDTALYYCAAEMSGISGWDYWGQGTLVTVKSA

SEQ ID NO: 458 - protein, 120 aa, Artificial Sequence
  Artificial polymer
EVQLVESGGGLVQAGGSLRLSCAASGGTFSFYGMGWFRQAPGKEQEFVADIRTSAGRTYYADSVKGRFTISRDNAKNTVYLQMNSLKPEDTALYYCAAEMSGISGWDYWGQGTLVTVQSA

SEQ ID NO: 459 - protein, 120 aa, Artificial Sequence
  Artificial polymer
EVQLVESGGGLVQAGGSLRLSCAASGGTFSFYGMGWFRQAPGKEQEFVADIRTSAGRTYYADSVKGRFTISRDNAKNTVYLQMNSLKPEDTALYYCAAEMSGISGWDYWGQGTLVTVSSA

SEQ ID NO: 460 - protein, 120 aa, Artificial Sequence
  Artificial polymer
EVQLVESGGGVVQAGGSLRLSCAASGGTFSFYGMGWFRQAPGKEQEFVADIRTSAGRTYYADSVKGRFTISRDNAKNTVYLQMNSLKPEDTALYYCAAEMSGISGWDYWGQGTLVKVSSA

SEQ ID NO: 461 - protein, 120 aa, Artificial Sequence
  Artificial polymer
EVQLVESGGGVVQAGGSLRLSCAASGGTFSFYGMGWFRQAPGKEQEFVADIRTSAGRTYYADSVKGRFTISRDNAKNTVYLQMNSLKPEDTALYYCAAEMSGISGWDYWGQGTLVQVSSA

SEQ ID NO: 462 - protein, 120 aa, Artificial Sequence
  Artificial polymer
EVQLVESGGGVVQAGGSLRLSCAASGGTFSFYGMGWFRQAPGKEQEFVADIRTSAGRTYYADSVKGRFTISRDNAKNTVYLQMNSLKPEDTALYYCAAEMSGISGWDYWGQGTLVTVKSA

SEQ ID NO: 463 - protein, 120 aa, Artificial Sequence
  Artificial polymer
EVQLVESGGGVVQAGGSLRLSCAASGGTFSFYGMGWFRQAPGKEQEFVADIRTSAGRTYYADSVKGRFTISRDNAKNTVYLQMNSLKPEDTALYYCAAEMSGISGWDYWGQGTLVTVQSA

SEQ ID NO: 464 - protein, 120 aa, Artificial Sequence
  Artificial polymer
EVQLVESGGGVVQAGGSLRLSCAASGGTFSFYGMGWFRQAPGKEQEFVADIRTSAGRTYYADSVKGRFTISRDNAKNTVYLQMNSLKPEDTALYYCAAEMSGISGWDYWGQGTLVTVSSA

SEQ ID NO: 465 - protein, 120 aa, Artificial Sequence
  Artificial polymer
EVQLVESGGGVVQPGGSLRLSCAASGGTFSFYGMGWFRQAPGKEQEFVADIRTSAGRTYYADSVKGRFTISRDNSKNTVYLQMNSLRPEDTALYYCAAEMSGISGWDYWGQGTLVTVSSA

SEQ ID NO: 466 - protein, 119 aa, Artificial Sequence
  Artificial polymer
DVQLVESGGGVVQPGGSLRLSCAASGSIASIHAMGWFRQAPGKEREFVAVITWSGGITYYADSVKGRFTISRDNSKNTVYLQMNSLRPEDTALYYCAGDKHQSSWYDYWGQGTLVTVSS

SEQ ID NO: 467 - protein, 119 aa, Artificial Sequence
  Artificial polymer
EVQLVESGGGLVQPGGSLRLSCAASGSIASIHAMGWERQAPGKEREEVAVITWSGGITYYADSVKGRFTISRDNSKNTVYLQMNSLRPEDTAIYYCAGDKHQSSWYDYWGQGTLVTVSS

SEQ ID NO: 468 - protein, 119 aa, Artificial Sequence
  Artificial polymer
EVQLVESGGGVVQPGGSLRLSCAASGSIASIHAMGWERQAPGKEREEVAVITWSGGITYYADSVKGRFTISRDNSKNTVYLQMNSLRPEDTALYYCAGDKHQSSWYDYWGQGTLVTVSS

SEQ ID NO: 469 - protein, 270 aa, Artificial Sequence
  Artificial polymer
DVQLVESGGGVVQPGGSLRLSCAASGSIASIHAMGWERQAPGKEREEVAVITWSGGITYYADSVKGRFTISRDNSKNTVYLQMNSLRPEDTALYYCAGDKHQSSWYDYWGQGTLVTVSSGGGGSGGGGSGGGGSGGGGSGGGGSGGGGSGGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVTVSSA

SEQ ID NO: 470 - protein, 424 aa, Artificial Sequence
  Artificial polymer
DVQLVESGGGVVQPGGSLRLSCAASGSIASIHAMGWERQAPGKEREEVAVITWSGGITYYADSVKGRFTISRDNSKNTVYLQMNSLRPEDTALYYCAGDKHQSSWYDYWGQGTLVTVSSGGGGSGGGGSGGGGSGGGGSGGGGSGGGGSGGGGSEVQLVESGGGVVQPGGSLRLSCAASGSIASIHAMGWFRQAPGKEREFVAVITWSGGITYYADSVKGRFTISRDNSKNTVYLQMNSLRPEDTALYYCAGDKHQSSWYDYWGQGTLVTVSSGGGGSGGGGSGGGGSGGGGSGGGGSGGGGSGGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVTVSSA

SEQ ID NO: 471 - protein, 119 aa, Artificial Sequence
  Artificial polymer
DVQLVESGGGVVQPGGSLRLSCAASGSIASIHAMGWERQAPGKEREEVAVITVSGGITYYADSVKGRFTISRDNSKNTVYLQMNSLRPEDTALYYCAGDKHQSSFYDYWGQGTLVTVSS

SEQ ID NO: 472 - protein, 119 aa, Artificial Sequence
  Artificial polymer
DVQLVESGGGVVQPGGSLRLSCAASGSIASIHAMGWFRQAPGKEREFVAVITVSGGITYYADSVKGRFTISRDQSKNTVYLQMNSLRPEDTALYYCAGDKHQSSFYDYWGQGTLVTVSS

SEQ ID NO: 473 - protein, 119 aa, Artificial Sequence
  Artificial polymer
DVQLVESGGGVVQPGGSLRLSCAASGSIASIHAMGWFRQAPGKEREFVAVITVSGGITYYADSVKGRFTISRDPSKNTVYLQMNSLRPEDTALYYCAGDKHQSSFYDYWGQGTLVTVSS

SEQ ID NO: 474 - protein, 119 aa, Artificial Sequence; identical to SEQ ID NO: 473
  Artificial polymer

SEQ ID NO: 475 - protein, 119 aa, Artificial Sequence; identical to SEQ ID NO: 472
  Artificial polymer

SEQ ID NO: 476 - protein, 119 aa, Artificial Sequence
  Artificial polymer
DVQLVESGGGVVQPGGSLRLSCAASGSIASIHAMGWFRQAPGKEREFVAVITVSGGITYYADSVKGRFTISRDSSKNTVYLQMNSLRPEDTALYYCAGDKHQSSFYDYWGQGTLVTVSS

SEQ ID NO: 477 - protein, 423 aa, Artificial Sequence
  Artificial polymer
EVQLVESGGGLVQPGGSLRLSCAASGSIASIHAMGWERQAPGKEREEVAVITWSGGITYYADSVKGRFTISRDNSKNTVYLQMNSLRPEDTAIYYCAGDKHQSSWYDYWGQGTLVTVSSGGGGSGGGGSGGGGSGGGGSGGGGSGGGGSGGGGSEVQLVESGGGLVQPGGSLRLSCAASGSIASIHAMGWERQAPGKEREEVAVITWSGGITYYADSVKGRFTISRDNSKNTVYLQMNSLRPEDTAIYYCAGDKHQSSWYDYWGQGTLVTVSSGGGGSGGGGSGGGGSGGGGSGGGGSGGGGSGGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 478 - protein, 287 aa, Artificial Sequence
  Artificial polymer
MQIPQAPWPVVWAVLQLGWRPGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQFQTLVVGVVGGLLGSLVLLVWVLAVICSRAARGTIGARRTGQPLKEDPSAVPVFVDYGELDFQWREKTPEPPVPCVPEQTEYATIVFPSGMGTSSPARRGSADGPRSAQPLRPEDGHCSWPL

SEQ ID NO: 479 - protein, 119 aa, Artificial Sequence
  Artificial polymer
EVQLVESGGGLVQAGGSLRLSCAASGGTFSFYGMGWFRQAPGKEQEFVADIRTSAGRTYYADSVKGRFTISRDNAKNTVYLQMNSLKPEDTAVYYCAAEMSGISGWDYWGQGTQVTVSS

SEQ ID NO: 480 - protein, 119 aa, Artificial Sequence; identical to SEQ ID NO: 434
  Artificial polymer

SEQ ID NO: 481 - protein, 119 aa, Artificial Sequence
  Artificial polymer
EVQLVESGGGVVQAGGSLRLSCAASGSIASIHAMGWFRQAPGKEREFVAVITWSGGITYYADSVKGRFTISRDNAKNTVYLQMNSLKPEDTAIYYCAGDKHQSSWYDYWGQGTLVKVSS

SEQ ID NO: 482 - protein, 119 aa, Artificial Sequence
  Artificial polymer
EVQLVESGGGVVQAGGSLRLSCAASGSIASIHAMGWFRQAPGKEREFVAVITWSGGITYYADSVKGRFTISRDNAKNTVYLQMNSLKPEDTAIYYCAGDKHQSSWYDYWGQGTLVQVSS

SEQ ID NO: 483 - protein, 119 aa, Artificial Sequence
  Artificial polymer
EVQLVESGGGVVQAGGSLRLSCAASGSIASIHAMGWFRQAPGKEREFVAVITWSGGITYYADSVKGRFTISRDNAKNTVYLQMNSLKPEDTAIYYCAGDKHQSSWYDYWGQGTLVTVKS

SEQ ID NO: 484 - protein, 119 aa, Artificial Sequence
  Artificial polymer
EVQLVESGGGVVQAGGSLRLSCAASGSIASIHAMGWFRQAPGKEREFVAVITWSGGITYYADSVKGRFTISRDNAKNTVYLQMNSLKPEDTAIYYCAGDKHQSSWYDYWGQGTLVTVQS

SEQ ID NO: 485 - protein, 119 aa, Artificial Sequence
  Artificial polymer
EVQLVESGGGLVQAGGSLRLSCAASGSIASIHAMGWFRQAPGKEREFVAVITWSGGITYYADSVKGRFTISRDNAKNTVYLQMNSLKPEDTALYYCAGDKHQSSWYDYWGQGTLVKVSS

SEQ ID NO: 486 - protein, 119 aa, Artificial Sequence
  Artificial polymer
EVQLVESGGGLVQAGGSLRLSCAASGSIASIHAMGWFRQAPGKEREFVAVITWSGGITYYADSVKGRFTISRDNAKNTVYLQMNSLKPEDTALYYCAGDKHQSSWYDYWGQGTLVQVSS

SEQ ID NO: 487 - protein, 119 aa, Artificial Sequence
  Artificial polymer
EVQLVESGGGLVQAGGSLRLSCAASGSIASIHAMGWFRQAPGKEREFVAVITWSGGITYYADSVKGRFTISRDNAKNTVYLQMNSLKPEDTALYYCAGDKHQSSWYDYWGQGTLVTVKS

SEQ ID NO: 488 - protein, 119 aa, Artificial Sequence
  Artificial polymer
EVQLVESGGGLVQAGGSLRLSCAASGSIASIHAMGWFRQAPGKEREFVAVITWSGGITYYADSVKGRFTISRDNAKNTVYLQMNSLKPEDTALYYCAGDKHQSSWYDYWGQGTLVTVQS

SEQ ID NO: 489 - protein, 119 aa, Artificial Sequence
  Artificial polymer
EVQLVESGGGVVQAGGSLRLSCAASGSIASIHAMGWFRQAPGKEREFVAVITWSGGITYYADSVKGRFTISRDNAKNTVYLQMNSLKPEDTALYYCAGDKHQSSWYDYWGQGTLVTVSS

SEQ ID NO: 490 - protein, 119 aa, Artificial Sequence
  Artificial polymer
EVQLVESGGGVVQAGGSLRLSCAASGSIASIHAMGWFRQAPGKEREFVAVITWSGGITYYADSVKGRFTISRDNAKNTVYLQMNSLKPEDTALYYCAGDKHQSSWYDYWGQGTLVKVSS

SEQ ID NO: 491 - protein, 119 aa, Artificial Sequence
  Artificial polymer
EVQLVESGGGVVQAGGSLRLSCAASGSIASIHAMGWFRQAPGKEREFVAVITWSGGITYYADSVKGRFTISRDNAKNTVYLQMNSLKPEDTALYYCAGDKHQSSWYDYWGQGTLVQVSS

SEQ ID NO: 492 - protein, 119 aa, Artificial Sequence
  Artificial polymer
EVQLVESGGGVVQAGGSLRLSCAASGSIASIHAMGWFRQAPGKEREFVAVITWSGGITYYADSVKGRFTISRDNAKNTVYLQMNSLKPEDTALYYCAGDKHQSSWYDYWGQGTLVTVKS

SEQ ID NO: 493 - protein, 119 aa, Artificial Sequence
  Artificial polymer
EVQLVESGGGVVQAGGSLRLSCAASGSIASIHAMGWFRQAPGKEREFVAVITWSGGITYYADSVKGRFTISRDNAKNTVYLQMNSLKPEDTALYYCAGDKHQSSWYDYWGQGTLVTVQS

SEQ ID NO: 494 - protein, 119 aa, Artificial Sequence
  Artificial polymer
EVQLVESGGGVVQPGGSLRLSCAASGSIASIHAMGWFRQAPGKEREFVAVITWSGGITYYADSVKGRFTISRDNSKNTVYLQMNSLRPEDTALYYCAGDKHQSSWYDYWGQGTLVTVSS

SEQ ID NO: 495 - protein, 119 aa, Artificial Sequence; identical to SEQ ID NO: 466
  Artificial polymer

SEQ ID NO: 496 - protein, 120 aa, Artificial Sequence
  Artificial polymer
EVQLVESGGGLVQAGGSLRLSCAASGSIASIHAMGWFRQAPGKEREFVAVITWSGGITYYADSVKGRFTISRDNAKNTVYLQMNSLKPEDTATYYCAGDKHQSSWYDYWGQGTLVTVSSA

SEQ ID NO: 497 - protein, 120 aa, Artificial Sequence
  Artificial polymer
EVQLVESGGGVVQAGGSLRLSCAASGSIASIHAMGWFRQAPGKEREFVAVITWSGGITYYADSVKGRFTISRDNAKNTVYLQMNSLKPEDTAIYYCAGDKHQSSWYDYWGQGTLVKVSSA

SEQ ID NO: 498 - protein, 120 aa, Artificial Sequence
  Artificial polymer
EVQLVESGGGVVQAGGSLRLSCAASGSIASIHAMGWFRQAPGKEREFVAVITWSGGITYYADSVKGRFTISRDNAKNTVYLQMNSLKPEDTAIYYCAGDKHQSSWYDYWGQGTLVQVSSA

SEQ ID NO: 499 - protein, 120 aa, Artificial Sequence
  Artificial polymer
EVQLVESGGGVVQAGGSLRLSCAASGSIASIHAMGWFRQAPGKEREFVAVITWSGGITYYADSVKGRFTISRDNAKNTVYLQMNSLKPEDTAIYYCAGDKHQSSWYDYWGQGTLVTVKSA

SEQ ID NO: 500 - protein, 121 aa, Artificial Sequence
  Artificial polymer
EVQLVESGGGVVQAGGSLRLSCAASGSIASIHATVCWFRQAPGKEREFVAVITWSGGITYYADSVKGRFTISRDNAKNTVYLQMNSLKPEDTAIYYCAGDKHQSSWYDYWGQGTLVTVQSA

SEQ ID NO: 501 - protein, 121 aa, Artificial Sequence
  Artificial polymer
EVQLVESGGGLVQAGGSLRLSCAASGSIASIHATVCWFRQAPGKEREFVAVITWSGGITYYADSVKGRFTISRDNAKNTVYLQMNSLKPEDTALYYCAGDKHQSSWYDYWGQGTLVKVSSA

SEQ ID NO: 502 - protein, 120 aa, Artificial Sequence
  Artificial polymer
EVQLVESGGGLVQAGGSLRLSCAASGSIASIHAMGWFRQAPGKEREFVAVITWSGGITYYADSVKGRFTISRDNAKNTVYLQMNSLKPEDTALYYCAGDKHQSSWYDYWGQGTLVQVSSA

SEQ ID NO: 503 - protein, 120 aa, Artificial Sequence
  Artificial polymer
EVQLVESGGGLVQAGGSLRLSCAASGSIASIHAMGWFRQAPGKEREFVAVITWSGGITYYADSVKGRFTISRDNAKNTVYLQMNSLKPEDTALYYCAGDKHQSSWYDYWGQGTLVTVKSA

SEQ ID NO: 504 - protein, 120 aa, Artificial Sequence
  Artificial polymer
EVQLVESGGGLVQAGGSLRLSCAASGSIASIHAMGWFRQAPGKEREFVAVITWSGGITYYADSVKGRFTISRDNAKNTVYLQMNSLKPEDTALYYCAGDKHQSSWYDYWGQGTLVTVQSA

SEQ ID NO: 505 - protein, 120 aa, Artificial Sequence
  Artificial polymer
EVQLVESGGGVVQAGGSLRLSCAASGSIASIHAMGWFRQAPGKEREFVAVITWSGGITYYADSVKGRFTISRDNAKNTVYLQMNSLKPEDTALYYCAGDKHQSSWYDYWGQGTLVTVSSA

SEQ ID NO: 506 - protein, 120 aa, Artificial Sequence
  Artificial polymer
EVQLVESGGGVVQAGGSLRLSCAASGSIASIHAMGWFRQAPGKEREFVAVITWSGGITYYADSVKGRFTISRDNAKNTVYLQMNSLKPEDTALYYCAGDKHQSSWYDYWGQGTLVKVSSA

SEQ ID NO: 507 - protein, 120 aa, Artificial Sequence
  Artificial polymer
EVQLVESGGGVVQAGGSLRLSCAASGSIASIHAMGWFRQAPGKEREFVAVITWSGGITYYADSVKGRFTISRDNAKNTVYLQMNSLKPEDTALYYCAGDKHQSSWYDYWGQGTLVQVSSA

SEQ ID NO: 508 - protein, 120 aa, Artificial Sequence
  Artificial polymer
EVQLVESGGGVVQAGGSLRLSCAASGSIASIHAMGWFRQAPGKEREFVAVITWSGGITYYADSVKGRFTISRDNAKNTVYLQMNSLKPEDTALYYCAGDKHQSSWYDYWGQGTLVTVKSA

SEQ ID NO: 509 - protein, 120 aa, Artificial Sequence
  Artificial polymer
EVQLVESGGGVVQAGGSLRLSCAASGSIASIHAMGWFRQAPGKEREFVAVITWSGGITYYADSVKGRFTISRDNAKNTVYLQMNSLKPEDTALYYCAGDKHQSSWYDYWGQGTLVTVQSA

SEQ ID NO: 510 - protein, 120 aa, Artificial Sequence
  Artificial polymer
EVQLVESGGGVVQPGGSLRLSCAASGSIASIHAMGWFRQAPGKEREFVAVITWSGGITYYADSVKGRFTISRDNSKNTVYLQMNSLRPEDTALYYCAGDKHQSSWYDYWGQGTLVTVSSA

SEQ ID NO: 511 - protein, 120 aa, Artificial Sequence
  Artificial polymer
DVQLVESGGGVVQPGGSLRLSCAASGSIASIHAMGWFRQAPGKEREFVAVITWSGGITYYADSVKGRFTISRDNSKNTVYLQMNSLRPEDTALYYCAGDKHQSSWYDYWGQGTLVTVSSA

SEQ ID NO: 512 - protein, 119 aa, Artificial Sequence
  Artificial polymer
DVQLVESGGGVVQPGGSLRLSCAASGSIASIHAMGWFRQAPGKEREFVAIITWSGGITYYADSVKGRFTISRDNSKNTVYLQMNSLRPEDTALYYCAGDKHQSSWYDYWGQGTLVTVSS

SEQ ID NO: 513 - protein, 119 aa, Artificial Sequence
  Artificial polymer
EVQLVESGGGLVQPGGSLRLSCAASGSIASIHAMGWFRQAPGKEREFVAVITWSGGITYYADSVKGRFTISRDNSKNTVYLQMNSLRPEDTAIYYCAGDKHQSSWYDYWGQGTLVTVSS

SEQ ID NO: 514 - protein, 119 aa, Artificial Sequence; identical to SEQ ID NO: 494
  Artificial polymer

SEQ ID NO: 515 - protein, 270 aa, Artificial Sequence
  Artificial polymer
DVQLVESGGGVVQPGGSLRLSCAASGSIASIHAMGWFRQAPGKEREFVAVITWSGGITYYADSVKGRFTISRDNSKNTVYLQMNSLRPEDTALYYCAGDKHQSSWYDYWGQGTLVTVSSGGGGSGGGGSGGGGSGGGGSGGGGSGGGGSGGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVTVSSA

SEQ ID NO: 516 - protein, 424 aa, Artificial Sequence
  Artificial polymer
DVQLVESGGGVVQPGGSLRLSCAASGSIASIHAMGWFRQAPGKEREFVAVITWSGGITYYADSVKGRFTISRDNSKNTVYLQMNSLRPEDTALYYCAGDKHQSSWYDYWGQGTLVTVSSGGGGSGGGGSGGGGSGGGGSGGGGSGGGGSGGGGSEVQLVESGGGVVQPGGSLRLSCAASGSIASIHAMGWFRQAPGKEREFVAVITWSGGITYYADSVKGRFTISRDNSKNTVYLQMNSLRPEDTALYYCAGDKHQSSWYDYWGQGTLVTVSSGGGGSGGGGSGGGGSGGGGSGGGGSGGGGSGGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVTVSSA

SEQ ID NO: 517 - protein, 119 aa, Artificial Sequence
  Artificial polymer
DVQLVESGGGVVQPGGSLRLSCAASGSIASIHAMGWFRQAPGKEREFVAVITVSGGITYYADSVKGRFTISRDNSKNTVYLQMNSLRPEDTALYYCAGDKHQSSFYDYWGQGTLVTVSS

SEQ ID NO: 518 - protein, 119 aa, Artificial Sequence; identical to SEQ ID NO: 472
  Artificial polymer

SEQ ID NO: 519 - protein, 119 aa, Artificial Sequence; identical to SEQ ID NO: 473
  Artificial polymer

SEQ ID NO: 520 - protein, 290 aa, Artificial Sequence
  Artificial polymer
MRIFAVFIFMTYWHLLNAFTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERTHLVILGAILLCLGVALTFIFRLRKGRMMDVKKCGIQDTNSKKQSDTHLEET

SEQ ID NO: 521 - protein, 176 aa, Artificial Sequence
  Artificial polymer
MRIFAVFIFMTYWHLLNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERTHLVILGAILLCLGVALTFIFRLRKGRMMDVKKCGIQDTNSKKQSDTHLEET

SEQ ID NO: 522 - protein, 178 aa, Artificial Sequence
  Artificial polymer
MRIFAVFIFMTYWHLLNAFTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGD

SEQ ID NO: 523 - protein, 10 aa, Artificial Sequence
  Artificial polymer
GFTLDYYAIG

SEQ ID NO: 524 - protein, 10 aa, Artificial Sequence
  Artificial polymer
GTIFSINHMD

SEQ ID NO: 525 - protein, 10 aa, Artificial Sequence
  Artificial polymer
GFTFDDYGMS

SEQ ID NO: 526 - protein, 10 aa, Artificial Sequence
  Artificial polymer
GFTLDYYAIN

SEQ ID NO: 527 - protein, 10 aa, Artificial Sequence
  Artificial polymer
GTIFSINRMD

SEQ ID NO: 528 - protein, 10 aa, Artificial Sequence
  Artificial polymer
GFTFSSYGMS

SEQ ID NO: 529 - protein, 10 aa, Artificial Sequence
  Artificial polymer
GKIFSGNDMG

SEQ ID NO: 530 - protein, 10 aa, Artificial Sequence
  Artificial polymer
GTIFSINRMD

SEQ ID NO: 531 - protein, 10 aa, Artificial Sequence
  Artificial polymer
GFTFSSYGMS

SEQ ID NO: 532 - protein, 10 aa, Artificial Sequence
  Artificial polymer
GFTFNDYAMS

SEQ ID NO: 533 - protein, 10 aa, Artificial Sequence
  Artificial polymer
GFNLDPYAIA

SEQ ID NO: 534 - protein, 10 aa, Artificial Sequence
  Artificial polymer
GFTFTAYAMS

SEQ ID NO: 535 - protein, 10 aa, Artificial Sequence
  Artificial polymer
GFTFDYYAIG

SEQ ID NO: 536 - protein, 10 aa, Artificial Sequence
  Artificial polymer
GFNLDPYAIA

SEQ ID NO: 537 - protein, 10 aa, Artificial Sequence
  Artificial polymer
GTIFSINRMD

SEQ ID NO: 538 - protein, 10 aa, Artificial Sequence
  Artificial polymer
GTIFSINRMD

SEQ ID NO: 539 - protein, 10 aa, Artificial Sequence
  Artificial polymer
GFTFSSYGMS

SEQ ID NO: 540 - protein, 10 aa, Artificial Sequence
  Artificial polymer
GFNLDPYAIG

SEQ ID NO: 541 - protein, 10 aa, Artificial Sequence
  Artificial polymer
GFNLDPYAIA

SEQ ID NO: 542 - protein, 10 aa, Artificial Sequence
  Artificial polymer
ESIFSIEAMG

SEQ ID NO: 543 - protein, 10 aa, Artificial Sequence
  Artificial polymer
GKIFSGNDMG

SEQ ID NO: 544 - protein, 10 aa, Artificial Sequence
  Artificial polymer
GFTLDYYAIG

SEQ ID NO: 545 - protein, 10 aa, Artificial Sequence
  Artificial polymer
GFTFSSYGMS

SEQ ID NO: 546 - protein, 10 aa, Artificial Sequence
  Artificial polymer
GTIFSINRMD

SEQ ID NO: 547 - protein, 10 aa, Artificial Sequence
  Artificial polymer
GFTFSSYGMS

SEQ ID NO: 548 - protein, 10 aa, Artificial Sequence
  Artificial polymer
GFNLDPYAIA

SEQ ID NO: 549 - protein, 10 aa, Artificial Sequence
  Artificial polymer
GRTFSISAMG

SEQ ID NO: 550 - protein, 10 aa, Artificial Sequence
  Artificial polymer
GFTLDYYAIN

SEQ ID NO: 551 - protein, 10 aa, Artificial Sequence
  Artificial polymer
GFTFSSYGMS

SEQ ID NO: 552 - protein, 10 aa, Artificial Sequence
  Artificial polymer
GFTFNDYAMS

SEQ ID NO: 553 - protein, 10 aa, Artificial Sequence
  Artificial polymer
GFTLDYYAIG

SEQ ID NO: 554 - protein, 5 aa, Artificial Sequence
  Artificial polymer
YYAIG

SEQ ID NO: 555 - protein, 5 aa, Artificial Sequence
  Artificial polymer
YYAKC

SEQ ID NO: 556 - protein, 5 aa, Artificial Sequence
  Artificial polymer
QYDVG

SEQ ID NO: 557 - protein, 5 aa, Artificial Sequence
  Artificial polymer
NSAMG

SEQ ID NO: 558 - protein, 5 aa, Artificial Sequence
  Artificial polymer
DSIVS

SEQ ID NO: 559 - protein, 5 aa, Artificial Sequence
  Artificial polymer
INHMD

SEQ ID NO: 560 - protein, 5 aa, Artificial Sequence
  Artificial polymer
DYGMS

SEQ ID NO: 561 - protein, 5 aa, Artificial Sequence
  Artificial polymer
YYAIN

SEQ ID NO: 562 - protein, 5 aa, Artificial Sequence
  Artificial polymer
INRMD

SEQ ID NO: 563 - protein, 5 aa, Artificial Sequence
  Artificial polymer
SYGMS

SEQ ID NO: 564 - protein, 5 aa, Artificial Sequence
  Artificial polymer
GNDMG

SEQ ID NO: 565 - protein, 5 aa, Artificial Sequence
  Artificial polymer
DYAMS

SEQ ID NO: 566 - protein, 5 aa, Artificial Sequence
  Artificial polymer
PYAIA

SEQ ID NO: 567 - protein, 5 aa, Artificial Sequence
  Artificial polymer
AYAMS

SEQ ID NO: 568 - protein, 5 aa, Artificial Sequence
  Artificial polymer
PYAIG

SEQ ID NO: 569 - protein, 5 aa, Artificial Sequence
  Artificial polymer
IEAMG

SEQ ID NO: 570 - protein, 5 aa, Artificial Sequence
  Artificial polymer
ISAMG

SEQ ID NO: 571 - protein, 9 aa, Artificial Sequence
  Artificial polymer
ISSSDGSTY

SEQ ID NO: 572 - protein, 8 aa, Artificial Sequence
  Artificial polymer
ITSDGFPT

SEQ ID NO: 573 - protein, 9 aa, Artificial Sequence
  Artificial polymer
IRWNGGSTN

SEQ ID NO: 574 - protein, 9 aa, Artificial Sequence
  Artificial polymer
ISSSDGSTY

SEQ ID NO: 575 - protein, 8 aa, Artificial Sequence
  Artificial polymer
ITSDGTPT

SEQ ID NO: 576 - protein, 9 aa, Artificial Sequence
  Artificial polymer
IDSGGGSTS

SEQ ID NO: 577 - protein, 8 aa, Artificial Sequence
  Artificial polymer
ITSGGITD

SEQ ID NO: 578 - protein, 8 aa, Artificial Sequence
  Artificial polymer
ITSDGTPT

SEQ ID NO: 579 - protein, 9 aa, Artificial Sequence
  Artificial polymer
IDSGGGSTS

SEQ ID NO: 580 - protein, 9 aa, Artificial Sequence
  Artificial polymer
IRSNGGYTN

SEQ ID NO: 581 - protein, 9 aa, Artificial Sequence
  Artificial polymer
ISSSDVGTY

SEQ ID NO: 582 - protein, 9 aa, Artificial Sequence
  Artificial polymer
INSSDGSTY

SEQ ID NO: 583 - protein, 9 aa, Artificial Sequence
  Artificial polymer
ISGSDSSTY

SEQ ID NO: 584 - protein, 9 aa, Artificial Sequence
  Artificial polymer
ISSSDVGTY

SEQ ID NO: 585 - protein, 8 aa, Artificial Sequence
  Artificial polymer
ITSDGTPT

SEQ ID NO: 586 - protein, 8 aa, Artificial Sequence
  Artificial polymer
ITSDGTPA

SEQ ID NO: 587 - protein, 9 aa, Artificial Sequence
  Artificial polymer
IDSGGGSTS

SEQ ID NO: 588 - protein, 9 aa, Artificial Sequence
  Artificial polymer
ISSGDGSKY

SEQ ID NO: 589 - protein, 9 aa, Artificial Sequence
  Artificial polymer
ISSSDVGTY

SEQ ID NO: 590 - protein, 8 aa, Artificial Sequence
  Artificial polymer
IFGGGFTN

SEQ ID NO: 591 - protein, 8 aa, Artificial Sequence
  Artificial polymer
ITSGGITD

SEQ ID NO: 592 - protein, 9 aa, Artificial Sequence
  Artificial polymer
ISSSDGSTY

SEQ ID NO: 593 - protein, 9 aa, Artificial Sequence
  Artificial polymer
IDSGGGSTS

SEQ ID NO: 594 - protein, 8 aa, Artificial Sequence
  Artificial polymer
ITSDGTPT

SEQ ID NO: 595 - protein, 9 aa, Artificial Sequence
  Artificial polymer
IDSGGGSTS

SEQ ID NO: 596 - protein, 9 aa, Artificial Sequence
  Artificial polymer
ISSSDVGTY

SEQ ID NO: 597 - protein, 9 aa, Artificial Sequence
  Artificial polymer
ITWSGGSTS

SEQ ID NO: 598 - protein, 9 aa, Artificial Sequence
  Artificial polymer
ISSSDGSTY

SEQ ID NO: 599 - protein, 9 aa, Artificial Sequence
  Artificial polymer
IDSGGGSTS

SEQ ID NO: 600 - protein, 9 aa, Artificial Sequence
  Artificial polymer
IRSNGGYTN

SEQ ID NO: 601 - protein, 9 aa, Artificial Sequence
  Artificial polymer
ISSSDGSTY

SEQ ID NO: 602 - protein, 17 aa, Artificial Sequence
  Artificial polymer
SISSSDGSTYYADSVKG

SEQ ID NO: 603 - protein, 17 aa, Artificial Sequence
  Artificial polymer
CISSSDGSTYYADSVKG

SEQ ID NO: 604 - protein, 17 aa, Artificial Sequence
  Artificial polymer
CISGGDNSTYYADSVKG

SEQ ID NO: 605 - protein, 16 aa, Artificial Sequence
  Artificial polymer
FSSSGGRTIYPDSVKG

SEQ ID NO: 606 - protein, 16 aa, Artificial Sequence
  Artificial polymer
RITGGGLIAYTDSVKG

SEQ ID NO: 607 - protein, 16 aa, Artificial Sequence
  Artificial polymer
GISNGGTIKYAESVLG

SEQ ID NO: 608 - protein, 9 aa, Artificial Sequence
  Artificial polymer
LITSDGFPT

SEQ ID NO: 609 - protein, 16 aa, Artificial Sequence
  Artificial polymer
LITSDGFPTYADSAKG

SEQ ID NO: 610 - protein, 10 aa, Artificial Sequence
  Artificial polymer
AIRWNGGSTN

SEQ ID NO: 611 - protein, 17 aa, Artificial Sequence
  Artificial polymer
AIRWNGGSTNYADSVKG

SEQ ID NO: 612 - protein, 9 aa, Artificial Sequence
  Artificial polymer
LITSDGTPT

SEQ ID NO: 613 - protein, 16 aa, Artificial Sequence
  Artificial polymer
LITSDGTPTYADSAKG

SEQ ID NO: 614 - protein, 10 aa, Artificial Sequence
  Artificial polymer
AIDSGGGSTS

SEQ ID NO: 615 - protein, 17 aa, Artificial Sequence
  Artificial polymer
AIDSGGGSTSYADSVKG

SEQ ID NO: 616 - protein, 9 aa, Artificial Sequence
  Artificial polymer
IITSGGITD

SEQ ID NO: 617 - protein, 16 aa, Artificial Sequence
  Artificial polymer
IITSGGITDYADAVKG

SEQ ID NO: 618 - protein, 10 aa, Artificial Sequence
  Artificial polymer
GIRSNGGYTN

SEQ ID NO: 619 - protein, 17 aa, Artificial Sequence
  Artificial polymer
GIRSNGGYTNYADSVKG

SEQ ID NO: 620 - protein, 10 aa, Artificial Sequence
  Artificial polymer
CISSSDVGTY

SEQ ID NO: 621 - protein, 17 aa, Artificial Sequence
  Artificial polymer
CISSSDVGTYYADSVKG

SEQ ID NO: 622 - protein, 10 aa, Artificial Sequence
  Artificial polymer
CINSSDGSTY

SEQ ID NO: 623 - protein, 17 aa, Artificial Sequence
  Artificial polymer
CINSSDGSTYYADSVKG

SEQ ID NO: 624 - protein, 10 aa, Artificial Sequence
  Artificial polymer
CISGSDSSTY

SEQ ID NO: 625 - protein, 17 aa, Artificial Sequence
  Artificial polymer
CISGSDSSTYYADSVKG

SEQ ID NO: 626 - protein, 9 aa, Artificial Sequence
  Artificial polymer
LITSDGTPA

SEQ ID NO: 627 - protein, 16 aa, Artificial Sequence
  Artificial polymer
LITSDGTPAYADSAKG

SEQ ID NO: 628 - protein, 10 aa, Artificial Sequence
  Artificial polymer
CISSGDGSKY

SEQ ID NO: 629 - protein, 17 aa, Artificial Sequence
  Artificial polymer
CISSGDGSKYYADSVKG

SEQ ID NO: 630 - protein, 9 aa, Artificial Sequence
  Artificial polymer
AIFGGGFTN

SEQ ID NO: 631 - protein, 16 aa, Artificial Sequence
  Artificial polymer
AIFGGGFTNYADSVKG

SEQ ID NO: 632 - protein, 10 aa, Artificial Sequence
  Artificial polymer
AITWSGGSTS

SEQ ID NO: 633 - protein, 17 aa, Artificial Sequence
  Artificial polymer
AITWSGGSTSYTDSVKG

SEQ ID NO: 634 - protein, 16 aa, Artificial Sequence
  Artificial polymer
DGWSSCRHGINEYLYW

SEQ ID NO: 635 - protein, 8 aa, Artificial Sequence
  Artificial polymer
SSGVYNYW

SEQ ID NO: 636 - protein, 12 aa, Artificial Sequence
  Artificial polymer
QGYYCSGYGCPR

SEQ ID NO: 637 - protein, 17 aa, Artificial Sequence
  Artificial polymer
SGWRLCRPTDEYDYSYW

SEQ ID NO: 638 - protein, 8 aa, Artificial Sequence
  Artificial polymer
SSGVYNYW

SEQ ID NO: 639 - protein, 14 aa, Artificial Sequence
  Artificial polymer
QGYYCSGYGCSDYW

SEQ ID NO: 640 - protein, 7 aa, Artificial Sequence
  Artificial polymer
RDRTIWW

SEQ ID NO: 641 - protein, 8 aa, Artificial Sequence
  Artificial polymer
SSGVYNYW

SEQ ID NO: 642 - protein, 14 aa, Artificial Sequence
  Artificial polymer
QGYYCSGYGCSDYW

SEQ ID NO: 643 - protein, 12 aa, Artificial Sequence
  Artificial polymer
QGYYCSGYGCYP

SEQ ID NO: 644 - protein, 15 aa, Artificial Sequence
  Artificial polymer
DGYYYCSDYPHPLYW

SEQ ID NO: 645 - protein, 15 aa, Artificial Sequence
  Artificial polymer
DGWRDCTWSNEYAYW

SEQ ID NO: 646 - protein, 15 aa, Artificial Sequence
  Artificial polymer
TGWRTCRGLNEYDYW

SEQ ID NO: 647 - protein, 15 aa, Artificial Sequence
  Artificial polymer
DGYYYCSDYPHPLYW

SEQ ID NO: 648 - protein, 8 aa, Artificial Sequence
  Artificial polymer
SSGVYNYW

SEQ ID NO: 649 - protein, 8 aa, Artificial Sequence
  Artificial polymer
SSGVYNYW

SEQ ID NO: 650 - protein, 14 aa, Artificial Sequence
  Artificial polymer
QGYYCSGYGCSDYW

SEQ ID NO: 651 - protein, 15 aa, Artificial Sequence
  Artificial polymer
DGYYYCSDYPHPLYW

SEQ ID NO: 652 - protein, 15 aa, Artificial Sequence
  Artificial polymer
DGYYYCSDYPHPLYW

SEQ ID NO: 653 - protein, 13 aa, Artificial Sequence
  Artificial polymer
DLVSGSSRLYDYW

SEQ ID NO: 654 - protein, 7 aa, Artificial Sequence
  Artificial polymer
RDRTIWW

SEQ ID NO: 655 - protein, 16 aa, Artificial Sequence
  Artificial polymer
DGWSSCRHGINEYLYW

SEQ ID NO: 656 - protein, 14 aa, Artificial Sequence
  Artificial polymer
QGYYCSGYGCSDYW

SEQ ID NO: 657 - protein, 8 aa, Artificial Sequence
  Artificial polymer
SSGVYNYW

SEQ ID NO: 658 - protein, 14 aa, Artificial Sequence
  Artificial polymer
QGYYCSGYGCSDYW

SEQ ID NO: 659 - protein, 15 aa, Artificial Sequence
  Artificial polymer
DGYYYCSDYPHPLYW

SEQ ID NO: 660 - protein, 18 aa, Artificial Sequence
  Artificial polymer
MGRTNYGVIYDPNMYNYW

SEQ ID NO: 661 - protein, 17 aa, Artificial Sequence
  Artificial polymer
SGWRLCRPTDEYDYLYW

SEQ ID NO: 662 - protein, 14 aa, Artificial Sequence
  Artificial polymer
QGYYCSGYGCSDYW

SEQ ID NO: 663 - protein, 12 aa, Artificial Sequence
  Artificial polymer
QGYYCSGYGCYP

SEQ ID NO: 664 - protein, 16 aa, Artificial Sequence
  Artificial polymer
DGWSSCRHGINEYLYW

SEQ ID NO: 665 - protein, 17 aa, Artificial Sequence
  Artificial polymer
SQAPITIATMMKPFYDY

SEQ ID NO: 666 - protein, 14 aa, Artificial Sequence
  Artificial polymer
RHGGPLTVEYFFDY

SEQ ID NO: 667 - protein, 15 aa, Artificial Sequence
  Artificial polymer
GGWKYCSGYDPEYIY

SEQ ID NO: 668 - protein, 7 aa, Artificial Sequence
  Artificial polymer
DWYLNSY

SEQ ID NO: 669 - protein, 6 aa, Artificial Sequence
  Artificial polymer
INSRDG

SEQ ID NO: 670 - protein, 109 aa, Artificial Sequence
  Artificial polymer
QVQLQESGGGLVQAGGSLRLSCAASGFTLDYYAIGWFRQAPGKEREEVSCISSSDGSTYYADSVKGRFTISRDNAKNTVNLQMNSLKPEDTAVYYCATDGWSSCRHGIN

SEQ ID NO: 671 - protein, 134 aa, Artificial Sequence
  Artificial polymer
QVQLQESGGGLVQAGGSLRLSCTASGTIFSINHMDWFRQAPGKQRELVALITSDGFPTYADSAKGRFTISRDNTKKTVSLQMNSLKPEDTAVYYCHVSSGVYNYWGQGTQVTVSSAAAYPYDVPDYGSHHHHHH

SEQ ID NO: 672 - protein, 138 aa, Artificial Sequence
  Artificial polymer
QVQLQESGGGLVQPGGSLRLSCAASGFTFDDYGMSWVRQAPGKGLEWVSAIRWNGGSTNYADSVKGRFTISRDNAKNTLYLQMNSLKSEDTAVYYCAQGYYCSGYGCPRGQGTQVTVSSAAAYPYDVPDYGSHHHHHH

SEQ ID NO: 673 - protein, 144 aa, Artificial Sequence
  Artificial polymer
QVQLQESGGGLVQPGGSLRLSCAASGFTLDYYAINWFRQAPGKEREEVSCISSSDGSTYYADSVKGRFTISRDNAKNTVYLQMNSLKPEDTAVYYCATSGWRLCRPTDEYDYSYWGQGTQVTVSSAAAYPYDVPDYGSHHHHHH

SEQ ID NO: 674 - protein, 134 aa, Artificial Sequence
  Artificial polymer
QVQLQESGGGVVQAGGSLRLSCTASGTIFSINRMDWFRQAPGKQRELVALITSDGTPTYADSAKGRFTISRDNTKKTVSLQMNSLKPEDTAVYYCHVSSGVYNYWGQGTQVTVSSAAAYPYDVPDYGSHHHHHH

SEQ ID NO: 675 - protein, 140 aa, Artificial Sequence
  Artificial polymer
QVQLQESGGGLVQTGGSLRLSCAASGFTFSSYGMSWVRQTPGKGPEWVSAIDSGGGSTSYADSVKGRFTISRDNAKNTLYLQMNSLKPEDTAVYYCAQGYYCSGYGCSDYWGQGTQVTVSSAAAYPYDVPDYGSHHHHHH

SEQ ID NO: 676 - protein, 133 aa, Artificial Sequence
  Artificial polymer
QVQLQESGGGLVQPGGSLRLSCAASGKIFSGNDMGWYRQAPGKQRELVGIITSGGITDYADAVKGRFTISRDNAKNMMYLQMNSLKPEDTAVYYCNMRDRTIWWGQGTQVTVSSAAAYPYDVPDYGSHHHHHH

SEQ ID NO: 677 - protein, 134 aa, Artificial Sequence
  Artificial polymer
QVQLQESGGGSVQAGGSLRLSCTASGTIFSINRMDWFRQAPGKQRELVALITSDGTPTYADSAKGRFTISRDNTKKTVSLQMNSLKPEDTAVYYCHVSSGVYNYWGQGTQVTVSSAAAYPYDVPDYGSHHHHHH

SEQ ID NO: 678 - protein, 140 aa, Artificial Sequence
  Artificial polymer
QVQLQESGGGLVQPGGSLRLSCAASGFTFSSYGMSWVRQTPGKGPEWVSAIDSGGGSTSYADSVKGRFTTSRDNAKNTLYLQMNSLKPEDTAVYYCAQGYYCSGYGCSDYWGQGTQVTVSSAAAYPYDVPDYGSHHHHHH

SEQ ID NO: 679 - protein, 138 aa, Artificial Sequence
  Artificial polymer
QVQLQESGGGLVQPGGSLRLSCAASGFTFNDYAMSWVRQAPGKGLEWVSGIRSNGGYTNYADSVKGRFTISRDNAKNTLYLQMNSLKSEDTAVYYCAQGYYCSGYGCYPGQGTQVTVSSAAAYPYDVPDYGSHHHHHH

SEQ ID NO: 680 - protein, 142 aa, Artificial Sequence
  Artificial polymer
QVQLQESGGGLVQAGGSLRLSCAASGFNLDPYAIAWFRQAPGKEREEVSCISSSDVGTYYADSVKGRFTISRDNAKKTVYLQMNSLKPEDTAVYYCATDGYYYCSDYPHPLYWGQGTQVTVSSAAAYPYDVPDYGSHHHHHH

SEQ ID NO: 681 - protein, 142 aa, Artificial Sequence
  Artificial polymer
QVQLQESGGGLVQPGGSLRLSCAASGFTFTAYAMSWFRQAPGKEREEVSCINSSDGSTYYADSVKGRFTISRDNAKNTVYLQMNSLKPEDTAVYHCATDGWRDCTWSNEYAYWGQGTQVTVSSAAAYPYDVPDYGSHHHHHH

SEQ ID NO: 682 - protein, 142 aa, Artificial Sequence
  Artificial polymer
QVQLQESGGGLVQPGGSLRLSCAASGFTFDYYAIGWFRQAPGKEREEVSCISGSDSSTYYADSVKGRFTIVRDNAQNTVYLQMNSLKPEDTAIYYCAVTGWRTCRGLNEYDYWGQGTQVTVSSAAAYPYDVPDYGSHHHHHH

SEQ ID NO: 683 - protein, 142 aa, Artificial Sequence
  Artificial polymer
QVQLQESGGGLVQPGGSLRLSCAASGFNLDPYAIAWFRQAPGKEREEVSCISSSDVGTYYADSVKGRFTISRDNTKKTVYLQMNSLKPEDTAVYYCATDGYYYCSDYPHPLYWGQGTQVTVSSAAAYPYDVPDYGSHHHHHH

SEQ ID NO: 684 - protein, 134 aa, Artificial Sequence
  Artificial polymer
QVQLQESGGGLVQAGESLRLSCTASGTIFSINRMDWFRQAPGKQRELVALITSDGTPTYADSAKGRFTISRDNTKKTVSLQMNSLKPEDTAVYYCHVSSGVYNYWGQGTQVTVSSAAAYPYDVPDYGSHHHHHH

SEQ ID NO: 685 - protein, 134 aa, Artificial Sequence
  Artificial polymer
QVQLQESGGGLVQAGGSLRLSCTASGTIFSINRMDWFRQAPGKQRELVALITSDGTPAYADSAKGRFTISRDNTKKTVSLQMNSLKPEDTAVYYCHVSSGVYNYWGQGTQVTVSSAAAYPYDVPDYGSHHHHHH

SEQ ID NO: 686 - protein, 140 aa, Artificial Sequence
  Artificial polymer
QVQLQESGGGLVQSGGSLRLSCKTSGFTFSSYGMSWVRQTPGKGPEWVSAIDSGGGSTSYADSVKGRFTISRDNAKNTLYLQMNSLKPEDTAVYYCAQGYYCSGYGCSDYWGQGTQVTVSSAAAYPYDVPDYGSHHHHHH

SEQ ID NO: 687 - protein, 142 aa, Artificial Sequence
  Artificial polymer
QVQLQESGGGLVQPGGSLRLSCAASGFNLDPYAIGWFRQAPGKEREEVSCISSGDGSKYYADSVKGRFTMSRDNAKKTVYLQMNSLKPEDTAVYYCATDGYYYCSDYPHPLYWGQGTQVTVSSAAAYPYDVPDYGSHHHHHH

SEQ ID NO: 688 - protein, 142 aa, Artificial Sequence
  Artificial polymer
QVQLQESGGGLVQPGGSLRLSCAVSGFNLDPYAIAWFRQAPGKEREEVSCISSSDVGTYYADSVKGRFTISRDNAKKTVYLQMNSLKPEDTAVYYCATDGYYYCSDYPHPLYWGQGTQVTVSSAAAYPYDVPDYGSHHHHHH

SEQ ID NO: 689 - protein, 139 aa, Artificial Sequence
  Artificial polymer
QVQLQESGGGLVQAGGSLRLSCAASESIFSIEAMGWYRQAPGKQRELVAAIFGGGFTNYADSVKGRFTISRDNANRTVYLQMNSLKPEDTAVYYCNADLVSGSSRLYDYWGQGTQVTVSSAAAYPYDVPDYGSHHHHHH

SEQ ID NO: 690 - protein, 133 aa, Artificial Sequence
  Artificial polymer
QVQLQESGGGLVQAGGSLRLSCAASGKIFSGNDMGWYRQAPGKQRELVGIITSGGITDYADAVKGRFTISRDNAKNMMYLQMNSLKPEDTAVYYCNMRDRTIWWGQGTQVTVSSAAAYPYDVPDYGSHHHHHH

SEQ ID NO: 691 - protein, 143 aa, Artificial Sequence
  Artificial polymer
QVQLQESGGGLVQPGGSLRLSCAASGFTLDYYAIGWFRQAPGKEREEVSCISSSDGSTYYADSVKGRFTISRDNAKNTVNLQMNSLKPEDTAVYYCATDGWSSCRHGINEYLYWGQGTQVTVSSAAAYPYDVPDYGSHHHHHH

SEQ ID NO: 692 - protein, 101 aa, Artificial Sequence
  Artificial polymer
QVQLQESGGGLVQAGGSLRLSCAASGFTFSSYGMSWVRQTPGKGPEWVSAIDSGGGSTSYADSVKGRFTISRDNAKNTLYLQMNSLKPEDTAVYYCAQGYY

SEQ ID NO: 693 - protein, 134 aa, Artificial Sequence
  Artificial polymer
QVQLQESGGGLVQPGGSLRLSCTASGTIFSINRMDWFRQAPGKQRELVALITSDGTPTYADSAKGRFTISRDNTKKTVSLQMNSLKPEDTAVYYCHVSSGVYNYWGQGTQVTVSSAAAYPYDVPDYGSHHHHHH

SEQ ID NO: 694 - protein, 140 aa, Artificial Sequence
  Artificial polymer
QVQLQESGGGLVQPGGSLRLSCAASGFTFSSYGMSWVRQTPGKGPEWVSAIDSGGGSTSYADSVKGRFTISRDNAKNTLYLQMNSLKPEDTAVYYCAQGYYCSGYGCSDYWGQGTQVTVSSAAAYPYDVPDYGSHHHHHH

SEQ ID NO: 695 - protein, 142 aa, Artificial Sequence
  Artificial polymer
QVQLQESGGGLVQPGGSLRLSCAASGFNLDPYAIAWFRQAPGKEREEVSCISSSDVGTYYADSVKGRFTISRDNAKKTVYLQMNSLKPEDTAVYYCATDGYYYCSDYPHPLYWGQGTQVTVSSAAAYPYDVPDYGSHHHHHH

SEQ ID NO: 696 - protein, 145 aa, Artificial Sequence
  Artificial polymer
  misc_feature (13)..(13): Xaa can be any naturally occurring amino acid
QVQLQESGGGLVXAGGSLRLSCAASGRTFSISAMGWFRQAPGKEREFVAAITWSGGSTSYTDSVKGRFTISRDNAKNTLYLQMNSLKPEDTAIYYCAAMGRTNYGVIYDPNMYNYWGQGTQVTVSSAAAYPYDVPDYGSHHHHHH

SEQ ID NO: 697 - protein, 144 aa, Artificial Sequence
  Artificial polymer
QVQLQESGGGLVQPGGSLRLSCAASGFTLDYYAINWFRQAPGKEREEVSCISSSDGSTYYADSVKGRFTISRDNAKNTVYLQMNSLKPEDTAVYYCATSGWRLCRPTDEYDYLYWGQGTQVTVSSAAAYPYDVPDYGSHHHHHH

SEQ ID NO: 698 - protein, 140 aa, Artificial Sequence
  Artificial polymer
QVQLQESGGGLVQAGGSMRLSCAASGFTFSSYGMSWVRQTPGKGPEWVSAIDSGGGSTSYADSVKGRFTISRDNAKNTLYLQMNSLKPEDTAVYYCAQGYYCSGYGCSDYWGQGTQVTVSSAAAYPYDVPDYGSHHHHHH

SEQ ID NO: 699 - protein, 138 aa, Artificial Sequence
  Artificial polymer
QVQLQESGGGTVQAGGSLRLSCAASGFTFNDYAMSWVRQAPGKGLEWVSGIRSNGGYTNYADSVKGRFTISRDNAKNTLYLQMNSLKSEDTAVYYCAQGYYCSGYGCYPGQGTQVTVSSAAAYPYDVPDYGSHHHHHH

SEQ ID NO: 700 - protein, 143 aa, Artificial Sequence
  Artificial polymer
QVQLQESGGGLVQPGTSLRLSCAASGFTLDYYAIGWFRQAPGKEREEVSCISSSDGSTYYADSVKGRFTISRDNAKNTVNLQMNSLKPEDTAVYYCATDGWSSCRHGINEYLYWGQGTQVTVSSAAAYPYDVPDYGSHHHHHH

SEQ ID NO: 701 - protein, 5 aa, Artificial Sequence
  Artificial polymer
INAMG

SEQ ID NO: 702 - protein, 9 aa, Artificial Sequence
  Artificial polymer
NYVSNYAMG

SEQ ID NO: 703 - protein, 5 aa, Artificial Sequence
  Artificial polymer
  misc_feature (2)..(2): Xaa can be any naturally occurring amino acid
IXVMG

SEQ ID NO: 704 - protein, 5 aa, Artificial Sequence
  Artificial polymer
SGTMG

SEQ ID NO: 705 - protein, 5 aa, Artificial Sequence
  Artificial polymer
YYGIG

SEQ ID NO: 706 - protein, 5 aa, Artificial Sequence
  Artificial polymer
TYTMI

SEQ ID NO: 707 - protein, 5 aa, Artificial Sequence
  Artificial polymer
SYDMS

SEQ ID NO: 708 - protein, 16 aa, Artificial Sequence
  Artificial polymer
SISSGGSTNYADSVKG

SEQ ID NO: 709 - protein, 16 aa, Artificial Sequence
  Artificial polymer
SISNGDTINYADSVKG

SEQ ID NO: 710 - protein, 16 aa, Artificial Sequence
  Artificial polymer
AITSGGRTNYSDSVKG

SEQ ID NO: 711 - protein, 17 aa, Artificial Sequence
  Artificial polymer
SIPWSGGRTYYADSVKD

SEQ ID NO: 712 - protein, 17 aa, Artificial Sequence
  Artificial polymer
FISGSDGSTYYAESVKG

SEQ ID NO: 713 - protein, 16 aa, Artificial Sequence
  Artificial polymer
TIDKDGNTNYVDSVKG

SEQ ID NO: 714 - protein, 16 aa, Artificial Sequence
  Artificial polymer
TINSGGGITYRGSVKG

SEQ ID NO: 715 - protein, 22 aa, Artificial Sequence
  Artificial polymer
DVYPQDYGLGYVEGKVYYGMDY

SEQ ID NO: 716 - protein, 7 aa, Artificial Sequence
  Artificial polymer
HQVAGLT

SEQ ID NO: 717 - protein, 10 aa, Artificial Sequence
  Artificial polymer
WNSGYPPVDY

SEQ ID NO: 718 - protein, 11 aa, Artificial Sequence
  Artificial polymer
KERSTGWDFAS

SEQ ID NO: 719 - protein, 18 aa, Artificial Sequence
  Artificial polymer
DPWGPPSIATMTSYEYKH

SEQ ID NO: 720 - protein, 5 aa, Artificial Sequence
  Artificial polymer
HGSSA

SEQ ID NO: 721 - protein, 6 aa, Artificial Sequence
  Artificial polymer
GGSSYR

SEQ ID NO: 722 - protein, 241 aa, Artificial Sequence
  Artificial polymer
MHEEEIYTSLQWDSPAPDTYQKCLSSNKCSGACCLVMVISCVFCMGLLTASIFLGVKLLQVSTIAMQQQEKLIQQERALLNFTEWKRSCALQMKYCQAFMQNSLSSAHNSSPCPNNWIQNRESCYYVSEIWSIWHTSQENCLKEGSTLLQIESKEEMDFITGSLRKIKGSYDYWVGLSQDGHSGRWLWQDGSSPSPGLLPAERSQSANQVCGYVKSNSLLSSNCSTWKYFICEKYALRSSV

SEQ ID NO: 723 - protein, 10 aa, Artificial Sequence
  Artificial polymer
GSISSINVMG

SEQ ID NO: 724 - protein, 10 aa, Artificial Sequence
  Artificial polymer
GSFSSINVMG

SEQ ID NO: 725 - protein, 10 aa, Artificial Sequence
  Artificial polymer
GSISSINIMG

SEQ ID NO: 726 - protein, 10 aa, Artificial Sequence
  Artificial polymer
GSISSINIMG

SEQ ID NO: 727 - protein, 10 aa, Artificial Sequence
  Artificial polymer
VSIFSINAMG

SEQ ID NO: 728 - protein, 10 aa, Artificial Sequence
  Artificial polymer
GSIFSLNAMG

SEQ ID NO: 729 - protein, 10 aa, Artificial Sequence
  Artificial polymer
GRTISNYDMA

SEQ ID NO: 730 - protein, 10 aa, Artificial Sequence
  Artificial polymer
GRTFTTSLMQ

SEQ ID NO: 731 - protein, 10 aa, Artificial Sequence
  Artificial polymer
ERNLRIYDMA

SEQ ID NO: 732 - protein, 10 aa, Artificial Sequence
  Artificial polymer
ERNLRSYDMA

SEQ ID NO: 733 - protein, 10 aa, Artificial Sequence
  Artificial polymer
GLTFSNYHMG

SEQ ID NO: 734 - protein, 10 aa, Artificial Sequence
  Artificial polymer
GLTFSSYHMG

SEQ ID NO: 735 - protein, 10 aa, Artificial Sequence
  Artificial polymer
GLTFSRYHMG

SEQ ID NO: 736 - protein, 10 aa, Artificial Sequence
  Artificial polymer
GLTLSSYYIA

SEQ ID NO: 737 - protein, 10 aa, Artificial Sequence
  Artificial polymer
GLTFSSYYTG

SEQ ID NO: 738 - protein, 10 aa, Artificial Sequence
  Artificial polymer
GLTLSSYHMG

SEQ ID NO: 739 - protein, 10 aa, Artificial Sequence
  Artificial polymer
GRTSSPYVTG

SEQ ID NO: 740 - protein, 10 aa, Artificial Sequence
  Artificial polymer
GFTFSGYVMS

SEQ ID NO: 741 - protein, 10 aa, Artificial Sequence
  Artificial polymer
GFTFSGYVMT

SEQ ID NO: 742 - protein, 10 aa, Artificial Sequence
  Artificial polymer
GFTFSGYLMS

SEQ ID NO: 743 - protein, 10 aa, Artificial Sequence
  Artificial polymer
GRISSINSMG

SEQ ID NO: 744 - protein, 10 aa, Artificial Sequence
  Artificial polymer
GSITSINAMG

SEQ ID NO: 745 - protein, 10 aa, Artificial Sequence
  Artificial polymer
GRFFRVNAMG

SEQ ID NO: 746 - protein, 10 aa, Artificial Sequence
  Artificial polymer
GSSDSINAMG

SEQ ID NO: 747 - protein, 10 aa, Artificial Sequence
  Artificial polymer
GSVFSINAWG

SEQ ID NO: 748 - protein, 10 aa, Artificial Sequence
  Artificial polymer
GSILSINSMG

SEQ ID NO: 749 - protein, 10 aa, Artificial Sequence
  Artificial polymer
VSISSINSMG

SEQ ID NO: 750 - protein, 10 aa, Artificial Sequence
  Artificial polymer
GRVFSINAMG

SEQ ID NO: 751 - protein, 10 aa, Artificial Sequence
  Artificial polymer
VNIDTLNSMA

SEQ ID NO: 752 - protein, 10 aa, Artificial Sequence
  Artificial polymer
GGISSINSMG

SEQ ID NO: 753 - protein, 10 aa, Artificial Sequence
  Artificial polymer
GSMHSVNSMA

SEQ ID NO: 754 - protein, 10 aa, Artificial Sequence
  Artificial polymer
GDISSINAMG

SEQ ID NO: 755 - protein, 10 aa, Artificial Sequence
  Artificial polymer
GSIFSIDAMG

SEQ ID NO: 756 - protein, 10 aa, Artificial Sequence
  Artificial polymer
GSIFSINAMG

SEQ ID NO: 757 - protein, 10 aa, Artificial Sequence
  Artificial polymer
GSIFSIAAMG

SEQ ID NO: 758 - protein, 10 aa, Artificial Sequence
  Artificial polymer
GNIASITAMG

SEQ ID NO: 759 - protein, 10 aa, Artificial Sequence
  Artificial polymer
GFTFDDYAIG

SEQ ID NO: 760 - protein, 10 aa, Artificial Sequence
  Artificial polymer
GSISSINAMG

SEQ ID NO: 761 - protein, 10 aa, Artificial Sequence
  Artificial polymer
VSIFRSYFMG

SEQ ID NO: 762 - protein, 10 aa, Artificial Sequence
  Artificial polymer
GSIVSINAIG

SEQ ID NO: 763 - protein, 10 aa, Artificial Sequence
  Artificial polymer
GSIFSINAMG

SEQ ID NO: 764 - protein, 10 aa, Artificial Sequence
  Artificial polymer
RSFSSFNAMG

SEQ ID NO: 765 - protein, 10 aa, Artificial Sequence
  Artificial polymer
GSFSSINAMG

SEQ ID NO: 766 - protein, 10 aa, Artificial Sequence
  Artificial polymer
GTSFSINGMA

SEQ ID NO: 767 - protein, 10 aa, Artificial Sequence
  Artificial polymer
GRTFSTYAMG

SEQ ID NO: 768 - protein, 10 aa, Artificial Sequence
  Artificial polymer
GSIFSINAMG

SEQ ID NO: 769 - protein, 10 aa, Artificial Sequence
  Artificial polymer
GRIFDINAMG

SEQ ID NO: 770 - protein, 10 aa, Artificial Sequence
  Artificial polymer
GTLFSINGMA

SEQ ID NO: 771 - protein, 10 aa, Artificial Sequence
  Artificial polymer
GSIDSINAMG

SEQ ID NO: 772 - protein, 10 aa, Artificial Sequence
  Artificial polymer
GRAFSTNSMG

SEQ ID NO: 773 - protein, 10 aa, Artificial Sequence
  Artificial polymer
GSIISINSMG

SEQ ID NO: 774 - protein, 10 aa, Artificial Sequence
  Artificial polymer
RNFFSINAMG

SEQ ID NO: 775 - protein, 10 aa, Artificial Sequence
  Artificial polymer
GRFFRVNAMG

SEQ ID NO: 776 - protein, 10 aa, Artificial Sequence
  Artificial polymer
GSIVSINSMG

SEQ ID NO: 777 - protein, 10 aa, Artificial Sequence
  Artificial polymer
GSIFSINAMG

SEQ ID NO: 778 - protein, 10 aa, Artificial Sequence
  Artificial polymer
GSIIGINSMG

SEQ ID NO: 779 - protein, 10 aa, Artificial Sequence
  Artificial polymer
GRTFPGYVMA

SEQ ID NO: 780 - protein, 10 aa, Artificial Sequence
  Artificial polymer
GSIFSINAMG

SEQ ID NO: 781 - protein, 10 aa, Artificial Sequence
  Artificial polymer
GRTFSINAMG

SEQ ID NO: 782 - protein, 10 aa, Artificial Sequence
  Artificial polymer
GRTLSSYTIG

SEQ ID NO: 783 - protein, 10 aa, Artificial Sequence
  Artificial polymer
GSFFSINAMG

SEQ ID NO: 784 - protein, 10 aa, Artificial Sequence
  Artificial polymer
GSIFSINSMG

SEQ ID NO: 785 - protein, 10 aa, Artificial Sequence
  Artificial polymer
GSIFSFNAMG

SEQ ID NO: 786 - protein, 10 aa, Artificial Sequence
  Artificial polymer
GSIFSINAMG

SEQ ID NO: 787 - protein, 10 aa, Artificial Sequence
  Artificial polymer
GRTFSTYAMA

SEQ ID NO: 788 - protein, 10 aa, Artificial Sequence
  Artificial polymer
GSFFSINAMG

SEQ ID NO: 789 - protein, 10 aa, Artificial Sequence
  Artificial polymer
VNIGSLNSMV

SEQ ID NO: 790 - protein, 10 aa, Artificial Sequence
  Artificial polymer
GRTLSNYAVG

SEQ ID NO: 791 - protein, 10 aa, Artificial Sequence
  Artificial polymer
GSISSINAMG

SEQ ID NO: 792 - protein, 10 aa, Artificial Sequence
  Artificial polymer
GRFFRVNAMG

SEQ ID NO: 793 - protein, 10 aa, Artificial Sequence
  Artificial polymer
GSVFSINAMG

SEQ ID NO: 794 - protein, 10 aa, Artificial Sequence
  Artificial polymer
GSIFEINSIG

SEQ ID NO: 795 - protein, 10 aa, Artificial Sequence
  Artificial polymer
GSIFNINSMG

SEQ ID NO: 796 - protein, 10 aa, Artificial Sequence
  Artificial polymer
VNIGTLNSMA

SEQ ID NO: 797 - protein, 10 aa, Artificial Sequence
  Artificial polymer
GSIFSINSMG

SEQ ID NO: 798 - protein, 10 aa, Artificial Sequence
  Artificial polymer
GRIGSINSMG

SEQ ID NO: 799 - protein, 10 aa, Artificial Sequence
  Artificial polymer
GSIFSFNAMG

SEQ ID NO: 800 - protein, 10 aa, Artificial Sequence
  Artificial polymer
GRISSINSMG

SEQ ID NO: 801 - protein, 10 aa, Artificial Sequence
  Artificial polymer
GRTLSNYAVA

SEQ ID NO: 802 - protein, 10 aa, Artificial Sequence
  Artificial polymer
GRIGSINSMG

SEQ ID NO: 803 - protein, 10 aa, Artificial Sequence
  Artificial polymer
RSFFSFNAMG

SEQ ID NO: 804 - protein, 10 aa, Artificial Sequence
  Artificial polymer
GRFFRVNAMG

SEQ ID NO: 805 - protein, 10 aa, Artificial Sequence
  Artificial polymer
GIIFSINAMG

SEQ ID NO: 806 - protein, 10 aa, Artificial Sequence
  Artificial polymer
GRTLSNYAVA

SEQ ID NO: 807 - protein, 10 aa, Artificial Sequence
  Artificial polymer
GRIFSVNAMG

SEQ ID NO: 808 - protein, 10 aa, Artificial Sequence
  Artificial polymer
GRTFSSYAMA

SEQ ID NO: 809 - protein, 10 aa, Artificial Sequence
  Artificial polymer
GSFSSINVMG

SEQ ID NO: 810 - protein, 5 aa, Artificial Sequence
  Artificial polymer
INSMG

SEQ ID NO: 811 - protein, 5 aa, Artificial Sequence
  Artificial polymer
INAMG

SEQ ID NO: 812 - protein, 5 aa, Artificial Sequence
  Artificial polymer
VNAMG

SEQ ID NO: 813 - protein, 5 aa, Artificial Sequence
  Artificial polymer
INAWG

SEQ ID NO: 814 - protein, 5 aa, Artificial Sequence
  Artificial polymer
LNSMA

SEQ ID NO: 815 - protein, 5 aa, Artificial Sequence
  Artificial polymer
VNSMA

SEQ ID NO: 816 - protein, 5 aa, Artificial Sequence
  Artificial polymer
IDAMG

SEQ ID NO: 817 - protein, 5 aa, Artificial Sequence
  Artificial polymer
IAAMG

SEQ ID NO: 818 - protein, 6 aa, Artificial Sequence
  Artificial polymer
SITAMG

SEQ ID NO: 819 - protein, 5 aa, Artificial Sequence
  Artificial polymer
DYAIG

SEQ ID NO: 820 - protein, 5 aa, Artificial Sequence
  Artificial polymer
SYFMG

SEQ ID NO: 821 - protein, 5 aa, Artificial Sequence
  Artificial polymer
INAIG

SEQ ID NO: 822 - protein, 5 aa, Artificial Sequence
  Artificial polymer
FNAMG

SEQ ID NO: 823 - protein, 5 aa, Artificial Sequence
  Artificial polymer
INGMA

SEQ ID NO: 824 - protein, 5 aa, Artificial Sequence
  Artificial polymer
TYAMG

SEQ ID NO: 825 - protein, 5 aa, Artificial Sequence
  Artificial polymer
TNSMG

SEQ ID NO: 826 - protein, 5 aa, Artificial Sequence
  Artificial polymer
GYVMA

SEQ ID NO: 827 - protein, 5 aa, Artificial Sequence
  Artificial polymer
SYTIG

SEQ ID NO: 828 - protein, 5 aa, Artificial Sequence
  Artificial polymer
TYAMA

SEQ ID NO: 829 - protein, 5 aa, Artificial Sequence
  Artificial polymer
LNSMV

SEQ ID NO: 830 - protein, 5 aa, Artificial Sequence
  Artificial polymer
NYAVG

SEQ ID NO: 831 - protein, 5 aa, Artificial Sequence
  Artificial polymer
INSIG

SEQ ID NO: 832 - protein, 5 aa, Artificial Sequence
  Artificial polymer
NYAVA

SEQ ID NO: 833 - protein, 5 aa, Artificial Sequence
  Artificial polymer
SYAMA

SEQ ID NO: 834 - protein, 5 aa, Artificial Sequence
  Artificial polymer
INVMG

SEQ ID NO: 835 - protein, 16 aa, Artificial Sequence
  Artificial polymer
RITNLGLPNYADWLKD

SEQ ID NO: 836 - protein, 16 aa, Artificial Sequence
  Artificial polymer
RITNLGLPNYADSVTG

SEQ ID NO: 837 - protein, 16 aa, Artificial Sequence
  Artificial polymer
RITNIGLPNYADSVKG

SEQ ID NO: 838 - protein, 16 aa, Artificial Sequence
  Artificial polymer
RITNLGLPNYADSVEG

SEQ ID NO: 839 - protein, 16 aa, Artificial Sequence
  Artificial polymer
AITSGGRVVYSDSVKG

SEQ ID NO: 840 - protein, 16 aa, Artificial Sequence
  Artificial polymer
AITSGGRTAYADSVKG

SEQ ID NO: 841 - protein, 16 aa, Artificial Sequence
  Artificial polymer
HITSDGRIVYADPVKG

SEQ ID NO: 842 - protein, 17 aa, Artificial Sequence
  Artificial polymer
RISGSGDRTDYADSVKG

SEQ ID NO: 843 - protein, 17 aa, Artificial Sequence
  Artificial polymer
SITWSTGNTHYADSVKG

SEQ ID NO: 844 - protein, 17 aa, Artificial Sequence
  Artificial polymer
VISSSGDSTHYSDFVKG

SEQ ID NO: 845 - protein, 17 aa, Artificial Sequence
  Artificial polymer
VITSSGDSTHYSDFVKG

SEQ ID NO: 846 - protein, 17 aa, Artificial Sequence
  Artificial polymer
QITWSDASIYYAGSVKG

SEQ ID NO: 847 - protein, 17 aa, Artificial Sequence
  Artificial polymer
QITWSDTSIYYAGSVKG

SEQ ID NO: 848 - protein, 17 aa, Artificial Sequence
  Artificial polymer
QITWSDGTTYYPGSVKG

SEQ ID NO: 849 - protein, 17 aa, Artificial Sequence
  Artificial polymer
QIRWSDDSTYYPGSVKG

SEQ ID NO: 850 - protein, 17 aa, Artificial Sequence
  Artificial polymer
QISWSDDSTYYADSVKG

SEQ ID NO: 851 - protein, 16 aa, Artificial Sequence
  Artificial polymer
TVSWGGVTYYADSVKG

SEQ ID NO: 852 - protein, 17 aa, Artificial Sequence
  Artificial polymer
SIGSGGGYPSYTDSVEG

SEQ ID NO: 853 - protein, 17 aa, Artificial Sequence
  Artificial polymer
SIGSGGGYPSYTGSVEG

SEQ ID NO: 854 - protein, 17 aa, Artificial Sequence
  Artificial polymer
HIGSGGGYPSYTDSVQG

SEQ ID NO: 855 - protein, 17 aa, Artificial Sequence
  Artificial polymer
HIGSGGGHATYTDSVEG

SEQ ID NO: 856 - protein, 17 aa, Artificial Sequence
  Artificial polymer
TIGSGGGITSYADSVKG

SEQ ID NO: 857 - protein, 16 aa, Artificial Sequence
  Artificial polymer
AITNGGAKTYADSVKG

SEQ ID NO: 858 - protein, 16 aa, Artificial Sequence
  Artificial polymer
AITSGGRLSYADSVKG

SEQ ID NO: 859 - protein, 16 aa, Artificial Sequence
  Artificial polymer
AITNGGQTAYADSVKG

SEQ ID NO: 860 - protein, 16 aa, Artificial Sequence
  Artificial polymer
AITSGGRSTYIDSAKG

SEQ ID NO: 861 - protein, 16 aa, Artificial Sequence
  Artificial polymer
AITNQGRIAYAPSVNG

SEQ ID NO: 862 - protein, 16 aa, Artificial Sequence
  Artificial polymer
AITNDGRTTYVDSVKG

SEQ ID NO: 863 - protein, 16 aa, Artificial Sequence
  Artificial polymer
AVTVGGRYAYADSAKN

SEQ ID NO: 864 - protein, 16 aa, Artificial Sequence
  Artificial polymer
AITNQGATTYADSVKG

SEQ ID NO: 865 - protein, 16 aa, Artificial Sequence
  Artificial polymer
GITGSGQITYANSVRG

SEQ ID NO: 866 - protein, 16 aa, Artificial Sequence
  Artificial polymer
AITNGGRTVYGDSVKG

SEQ ID NO: 867 - protein, 16 aa, Artificial Sequence
  Artificial polymer
AITSGGRLAYAPSVNG

SEQ ID NO: 868 - protein, 16 aa, Artificial Sequence
  Artificial polymer
AITNGGRTTYVDSVKG

SEQ ID NO: 869 - protein, 16 aa, Artificial Sequence
  Artificial polymer
AITTGGRTTYVDSVKG

SEQ ID NO: 870 - protein, 16 aa, Artificial Sequence
  Artificial polymer
AITNQGRLTYADSVKG

SEQ ID NO: 871 - protein, 16 aa, Artificial Sequence
  Artificial polymer
AITSGGRRAYADSVKG

SEQ ID NO: 872 - protein, 18 aa, Artificial Sequence
  Artificial polymer
AITSASASRTTYADSVKG

SEQ ID NO: 873 - protein, 17 aa, Artificial Sequence
  Artificial polymer
CISRSDGSTYYDDSVKG

SEQ ID NO: 874 - protein, 16 aa, Artificial Sequence
  Artificial polymer
AITNQGRVTYADSVKG

SEQ ID NO: 875 - protein, 16 aa, Artificial Sequence
  Artificial polymer
AITDGGRLAYADSAKG

SEQ ID NO: 876 - protein, 16 aa, Artificial Sequence
  Artificial polymer
SITNQGIRNYSTSVMG

SEQ ID NO: 877 - protein, 16 aa, Artificial Sequence
  Artificial polymer
AITNQGRTTYADSVKG

SEQ ID NO: 878 - protein, 16 aa, Artificial Sequence
  Artificial polymer
AITNGGRIAYGIAVNG

SEQ ID NO: 879 - protein, 16 aa, Artificial Sequence
  Artificial polymer
AITNGGRIAYSDSAKG

SEQ ID NO: 880 - protein, 16 aa, Artificial Sequence
  Artificial polymer
GITSDGSTGYADSVKG

SEQ ID NO: 881 - protein, 17 aa, Artificial Sequence
  Artificial polymer
AISWSGGSTYYADSVKG

SEQ ID NO: 882 - protein, 16 aa, Artificial Sequence
  Artificial polymer
AITDQGRLAYADSAKG

SEQ ID NO: 883 - protein, 16 aa, Artificial Sequence
  Artificial polymer
AITNGGQTTYADSVKG

SEQ ID NO: 884 - protein, 16 aa, Artificial Sequence
  Artificial polymer
GITSDGSTGYADSVKG

SEQ ID NO: 885 - protein, 16 aa, Artificial Sequence
  Artificial polymer
AITTGGRTAYVDSVKG

SEQ ID NO: 886 - protein, 16 aa, Artificial Sequence
  Artificial polymer
AITSQGRITLADSVKG

SEQ ID NO: 887 - protein, 16 aa, Artificial Sequence
  Artificial polymer
AITVDGRLAYADSAKH

SEQ ID NO: 888 - protein, 16 aa, Artificial Sequence
  Artificial polymer
AITNGGRIAYGTSVMG

SEQ ID NO: 889 - protein, 16 aa, Artificial Sequence
  Artificial polymer
AITNGGQIAYADSVKG

SEQ ID NO: 890 - protein, 16 aa, Artificial Sequence
  Artificial polymer
AITDQGRTTYADSVKG

SEQ ID NO: 891 - protein, 16 aa, Artificial Sequence
  Artificial polymer
GITTQGRITYGNSVRG

SEQ ID NO: 892 - protein, 16 aa, Artificial Sequence
  Artificial polymer
AITSGGRTTYVDSVKG

SEQ ID NO: 893 - protein, 17 aa, Artificial Sequence
  Artificial polymer
AINWRGGDTYYADSVKG

SEQ ID NO: 894 - protein, 16 aa, Artificial Sequence
  Artificial polymer
AITDGGAKTYADSVKG

SEQ ID NO: 895 - protein, 16 aa, Artificial Sequence
  Artificial polymer
AITNQGRLSYVDSVKG

SEQ ID NO: 896 - protein, 16 aa, Artificial Sequence
  Artificial polymer
AITNQGRRTYADSVKG

SEQ ID NO: 897 - protein, 16 aa, Artificial Sequence
  Artificial polymer
AITNGGRIAYTDSVKG

SEQ ID NO: 898 - protein, 16 aa, Artificial Sequence
  Artificial polymer
AITNGGRTTYADSVKG

SEQ ID NO: 899 - protein, 16 aa, Artificial Sequence
  Artificial polymer
AITDGGRLTYADSAKG

SEQ ID NO: 900 - protein, 16 aa, Artificial Sequence
  Artificial polymer
AITTGGRTTYVDSVKG

SEQ ID NO: 901 - protein, 17 aa, Artificial Sequence
  Artificial polymer
AISWSGGSTEYHDSVKG

SEQ ID NO: 902 - protein, 16 aa, Artificial Sequence
  Artificial polymer
AITNQGRIAYADSVKG

SEQ ID NO: 903 - protein, 16 aa, Artificial Sequence
  Artificial polymer
GITGSGQITYANSVRG

SEQ ID NO: 904 - protein, 17 aa, Artificial Sequence
  Artificial polymer
AINWSSGGISYSNSAKG

SEQ ID NO: 905 - protein, 16 aa, Artificial Sequence
  Artificial polymer
AITGQGRTTYADSVKG

SEQ ID NO: 906 - protein, 16 aa, Artificial Sequence
  Artificial polymer
AITNGGQIVYADSVKG

SEQ ID NO: 907 - protein, 16 aa, Artificial Sequence
  Artificial polymer
AITTQGRTTYEDSVKG

SEQ ID NO: 908 - protein, 16 aa, Artificial Sequence
  Artificial polymer
AITSGGITNYANSVQG

SEQ ID NO: 909 - protein, 16 aa, Artificial Sequence
  Artificial polymer
AITVGGRLAYADSAKG

SEQ ID NO: 910 - protein, 16 aa, Artificial Sequence
  Artificial polymer
GITGGGQITYANSVRG

SEQ ID NO: 911 - protein, 16 aa, Artificial Sequence
  Artificial polymer
AITSQGRSTYADSAKG

SEQ ID NO: 912 - protein, 16 aa, Artificial Sequence
  Artificial polymer
AITNGGATVYADSVKG

SEQ ID NO: 913 - protein, 16 aa, Artificial Sequence
  Artificial polymer
AITDGGRLTYADSAKN

SEQ ID NO: 914 - protein, 16 aa, Artificial Sequence
  Artificial polymer
AITNGGAKTYADSVKG

SEQ ID NO: 915 - protein, 17 aa, Artificial Sequence
  Artificial polymer
AINWSSGGISYSNAAKG

SEQ ID NO: 916 - protein, 16 aa, Artificial Sequence
  Artificial polymer
AITNGGATVYADSVKG

SEQ ID NO: 917 - protein, 16 aa, Artificial Sequence
  Artificial polymer
AITNGGRIAYGTSVMG

SEQ ID NO: 918 - protein, 16 aa, Artificial Sequence
  Artificial polymer
AITNGGQTAYADSVKG

SEQ ID NO: 919 - protein, 16 aa, Artificial Sequence
  Artificial polymer
  misc_feature (5)..(5): Xaa can be any naturally occurring amino acid
AITNXGRTTYADSVKG

SEQ ID NO: 920 - protein, 17 aa, Artificial Sequence
  Artificial polymer
AIWWASGGISYANSAKG

SEQ ID NO: 921 - protein, 16 aa, Artificial Sequence
  Artificial polymer
AITNQGAPTYADSVKG

SEQ ID NO: 922 - protein, 16 aa, Artificial Sequence
  Artificial polymer
RITNLGLPNYADSVTG

SEQ ID NO: 923 - protein, 16 aa, Artificial Sequence
  Artificial polymer
RITNLGLPNYADSVKG

SEQ ID NO: 924 - protein, 9 aa, Artificial Sequence
  Artificial polymer
AITNGGAKT

SEQ ID NO: 925 - protein, 9 aa, Artificial Sequence
  Artificial polymer
AITSGGRLS

SEQ ID NO: 926 - protein, 9 aa, Artificial Sequence
  Artificial polymer
AITNGGQTA

SEQ ID NO: 927 - protein, 9 aa, Artificial Sequence
  Artificial polymer
AITSGGRST

SEQ ID NO: 928 - protein, 8 aa, Artificial Sequence
  Artificial polymer
ITNQGRIA

SEQ ID NO: 929 - protein, 15 aa, Artificial Sequence
  Artificial polymer
ITNQGRIAYAPSVNG

SEQ ID NO: 930 - protein, 9 aa, Artificial Sequence
  Artificial polymer
AITNDGRTT

SEQ ID NO: 931 - protein, 9 aa, Artificial Sequence
  Artificial polymer
AVTVGGRYA

SEQ ID NO: 932 - protein, 9 aa, Artificial Sequence
  Artificial polymer
AITNQGATT

SEQ ID NO: 933 - protein, 9 aa, Artificial Sequence
  Artificial polymer
GITGSGQIT

SEQ ID NO: 934 - protein, 9 aa, Artificial Sequence
  Artificial polymer
AITNGGRTV

SEQ ID NO: 935 - protein, 9 aa, Artificial Sequence
  Artificial polymer
AITSGGRLA

SEQ ID NO: 936 - protein, 9 aa, Artificial Sequence
  Artificial polymer
AITNGGRTT

SEQ ID NO: 937 - protein, 9 aa, Artificial Sequence
  Artificial polymer
AITTGGRTT

SEQ ID NO: 938 - protein, 9 aa, Artificial Sequence
  Artificial polymer
AITNQGRLT

SEQ ID NO: 939 - protein, 9 aa, Artificial Sequence
  Artificial polymer
AITSGGRRA

SEQ ID NO: 940 - protein, 11 aa, Artificial Sequence
  Artificial polymer
AITSASASRTT

SEQ ID NO: 941 - protein, 10 aa, Artificial Sequence
  Artificial polymer
CISRSDGSTY

SEQ ID NO: 942 - protein, 9 aa, Artificial Sequence
  Artificial polymer
AITNQGRVT

SEQ ID NO: 943 - protein, 9 aa, Artificial Sequence
  Artificial polymer
AITDGGRLA

SEQ ID NO: 944 - protein, 9 aa, Artificial Sequence
  Artificial polymer
SITNQGIRN

SEQ ID NO: 945 - protein, 9 aa, Artificial Sequence
  Artificial polymer
AITNQGRTT

SEQ ID NO: 946 - protein, 9 aa, Artificial Sequence
  Artificial polymer
AITNGGRIA

SEQ ID NO: 947 - protein, 9 aa, Artificial Sequence
  Artificial polymer
GITSDGSTG

SEQ ID NO: 948 - protein, 10 aa, Artificial Sequence
  Artificial polymer
AISWSGGSTY

SEQ ID NO: 949 - protein, 9 aa, Artificial Sequence
  Artificial polymer
AITDQGRLA

SEQ ID NO: 950 - protein, 9 aa, Artificial Sequence
  Artificial polymer
AITNGGQTT

SEQ ID NO: 951 - protein, 9 aa, Artificial Sequence
  Artificial polymer
AITTGGRTA

SEQ ID NO: 952 - protein, 9 aa, Artificial Sequence
  Artificial polymer
AITSQGRIT

SEQ ID NO: 953 - protein, 9 aa, Artificial Sequence
  Artificial polymer
AITVDGRLA

SEQ ID NO: 954 - protein, 9 aa, Artificial Sequence
  Artificial polymer
AITNGGQIA

SEQ ID NO: 955 - protein, 9 aa, Artificial Sequence
  Artificial polymer
AITDQGRTT

SEQ ID NO: 956 - protein, 9 aa, Artificial Sequence
  Artificial polymer
GITTQGRIT

SEQ ID NO: 957 - protein, 9 aa, Artificial Sequence
  Artificial polymer
AITSGGRTT

SEQ ID NO: 958 - protein, 10 aa, Artificial Sequence
  Artificial polymer
AINWRGGDTY

SEQ ID NO: 959 - protein, 9 aa, Artificial Sequence
  Artificial polymer
AITDGGAKT

SEQ ID NO: 960 - protein, 9 aa, Artificial Sequence
  Artificial polymer
AITNQGRLS

SEQ ID NO: 961 - protein, 9 aa, Artificial Sequence
  Artificial polymer
AITNQGRRT

SEQ ID NO: 962 - protein, 9 aa, Artificial Sequence
  Artificial polymer
AITDGGRLT

SEQ ID NO: 963 - protein, 10 aa, Artificial Sequence
  Artificial polymer
AISWSGGSTE

SEQ ID NO: 964 - protein, 9 aa, Artificial Sequence
  Artificial polymer
AITNQGRIA

SEQ ID NO: 965 - protein, 10 aa, Artificial Sequence
  Artificial polymer
AINWSSGGIS

SEQ ID NO: 966 - protein, 9 aa, Artificial Sequence
  Artificial polymer
AITGQGRTT

SEQ ID NO: 967 - protein, 9 aa, Artificial Sequence
  Artificial polymer
AITNGGQIV

SEQ ID NO: 968 - protein, 9 aa, Artificial Sequence
  Artificial polymer
AITTQGRTT

SEQ ID NO: 969 - protein, 9 aa, Artificial Sequence
  Artificial polymer
AITSGGITN

SEQ ID NO: 970 - protein, 9 aa, Artificial Sequence
  Artificial polymer
AITVGGRLA

SEQ ID NO: 971 - protein, 9 aa, Artificial Sequence
  Artificial polymer
GITGGGQIT

SEQ ID NO: 972 - protein, 9 aa, Artificial Sequence
  Artificial polymer
AITSQGRST

SEQ ID NO: 973 - protein, 9 aa, Artificial Sequence
  Artificial polymer
AITNGGATV

SEQ ID NO: 974 - protein, 9 aa, Artificial Sequence
  Artificial polymer
  misc_feature (5)..(5): Xaa can be any naturally occurring amino acid
AITNXGRTT

SEQ ID NO: 975 - protein, 10 aa, Artificial Sequence
  Artificial polymer
AIWWASGGIS

SEQ ID NO: 976 - protein, 9 aa, Artificial Sequence
  Artificial polymer
AITNQGAPT

SEQ ID NO: 977 - protein, 9 aa, Artificial Sequence
  Artificial polymer
RITNLGLPN

SEQ ID NO: 978 - protein, 7 aa, Artificial Sequence
  Artificial polymer
VALSAEY

SEQ ID NO: 979 - protein, 7 aa, Artificial Sequence
  Artificial polymer
VALKAEY

SEQ ID NO: 980 - protein, 7 aa, Artificial Sequence
  Artificial polymer
VGLKAEY

SEQ ID NO: 981 - protein, 13 aa, Artificial Sequence
  Artificial polymer
KTKSAVLFGGMDY

SEQ ID NO: 982 - protein, 7 aa, Artificial Sequence
  Artificial polymer
YIRGEDY

SEQ ID NO: 983 - protein, 7 aa, Artificial Sequence
  Artificial polymer
KHYASNY

SEQ ID NO: 984 - protein, 8 aa, Artificial Sequence
  Artificial polymer
QDFGSPSF

SEQ ID NO: 985 - protein, 8 aa, Artificial Sequence
  Artificial polymer
QDFRSPDF

SEQ ID NO: 986 - protein, 8 aa, Artificial Sequence
  Artificial polymer
QIFGSPNF

SEQ ID NO: 987 - protein, 7 aa, Artificial Sequence
  Artificial polymer
LAIHGDY

SEQ ID NO: 988 - protein, 7 aa, Artificial Sequence
  Artificial polymer
NQIRQWP

SEQ ID NO: 989 - protein, 7 aa, Artificial Sequence
  Artificial polymer
NSIRQWP

SEQ ID NO: 990 - protein, 7 aa, Artificial Sequence
  Artificial polymer
NAIRQWP

SEQ ID NO: 991 - protein, 8 aa, Artificial Sequence
  Artificial polymer
RKVGGPDY

SEQ ID NO: 992 - protein, 7 aa, Artificial Sequence
  Artificial polymer
NTFGNVY

SEQ ID NO: 993 - protein, 7 aa, Artificial Sequence
  Artificial polymer
FTRRDDY

SEQ ID NO: 994 - protein, 7 aa, Artificial Sequence
  Artificial polymer
FQSSGID

SEQ ID NO: 995 - protein, 8 aa, Artificial Sequence
  Artificial polymer
WAADYQQY

SEQ ID NO: 996 - protein, 8 aa, Artificial Sequence
  Artificial polymer
WNRDRQQY

SEQ ID NO: 997 - protein, 13 aa, Artificial Sequence
  Artificial polymer
KPTPVYGSTVGDY

SEQ ID NO: 998 - protein, 7 aa, Artificial Sequence
  Artificial polymer
FTRDKDY

SEQ ID NO: 999 - protein, 8 aa, Artificial Sequence
  Artificial polymer
WDRDRQQY

SEQ ID NO: 1000 - protein, 7 aa, Artificial Sequence
  Artificial polymer
FTRTDDY

SEQ ID NO: 1001 - protein, 8 aa, Artificial Sequence
  Artificial polymer
YDRSSTPY

SEQ ID NO: 1002 - protein, 7 aa, Artificial Sequence
  Artificial polymer
FTRGDDY

SEQ ID NO: 1003 - protein, 7 aa, Artificial Sequence
  Artificial polymer
LNSATTY

SEQ ID NO: 1004 - protein, 7 aa, Artificial Sequence
  Artificial polymer
YTRDEDY

SEQ ID NO: 1005 - protein, 7 aa, Artificial Sequence
  Artificial polymer
FTRDEDY

SEQ ID NO: 1006 - protein, 13 aa, Artificial Sequence
  Artificial polymer
KWYDPLVIEYYDN

SEQ ID NO: 1007 - protein, 7 aa, Artificial Sequence
  Artificial polymer
KADHNDY

SEQ ID NO: 1008 - protein, 8 aa, Artificial Sequence
  Artificial polymer
FRSGADDY

SEQ ID NO: 1009 - protein, 15 aa, Artificial Sequence
  Artificial polymer
EVPSTYSCSGFREDY

SEQ ID NO: 1010 - protein, 8 aa, Artificial Sequence
  Artificial polymer
FAASGMEY

SEQ ID NO: 1011 - protein, 8 aa, Artificial Sequence
  Artificial polymer
WTTDRQQY

SEQ ID NO: 1012 - protein, 9 aa, Artificial Sequence
  Artificial polymer
FAGWGKEDY

SEQ ID NO: 1013 - protein, 7 aa, Artificial Sequence
  Artificial polymer
FSPTGDY

SEQ ID NO: 1014 - protein, 13 aa, Artificial Sequence
  Artificial polymer
KPTPVYGSTVGDY

SEQ ID NO: 1015 - protein, 13 aa, Artificial Sequence
  Artificial polymer
KASPVYGSTVEDY

SEQ ID NO: 1016 - protein, 8 aa, Artificial Sequence
  Artificial polymer
STPRGDSY

SEQ ID NO: 1017 - protein, 15 aa, Artificial Sequence
  Artificial polymer
EAEGSGREGNFYERS

SEQ ID NO: 1018 - protein, 8 aa, Artificial Sequence
  Artificial polymer
WDRDRQQY

SEQ ID NO: 1019 - protein, 7 aa, Artificial Sequence
  Artificial polymer
FTRSDDY

SEQ ID NO: 1020 - protein, 8 aa, Artificial Sequence
  Artificial polymer
STPRGDSY

SEQ ID NO: 1021 - protein, 7 aa, Artificial Sequence
  Artificial polymer
FTRDTDY

SEQ ID NO: 1022 - protein, 7 aa, Artificial Sequence
  Artificial polymer
WTTLGTF

SEQ ID NO: 1023 - protein, 8 aa, Artificial Sequence
  Artificial polymer
WVRDGQQY

SEQ ID NO: 1024 - protein, 13 aa, Artificial Sequence
  Artificial polymer
KAIPVYGSTVEDY

SEQ ID NO: 1025 - protein, 13 aa, Artificial Sequence
  Artificial polymer
KAAATHLSTVADY

SEQ ID NO: 1026 - protein, 7 aa, Artificial Sequence
  Artificial polymer
FGRFDDY

SEQ ID NO: 1027 - protein, 14 aa, Artificial Sequence
  Artificial polymer
WGVKTGPESGSGTL

SEQ ID NO: 1028 - protein, 7 aa, Artificial Sequence
  Artificial polymer
FTRDEDY

SEQ ID NO: 1029 - protein, 10 aa, Artificial Sequence
  Artificial polymer
RLTTEYDYAY

SEQ ID NO: 1030 - protein, 7 aa, Artificial Sequence
  Artificial polymer
FTRGNDY

SEQ ID NO: 1031 - protein, 7 aa, Artificial Sequence
  Artificial polymer
FQSSGID

SEQ ID NO: 1032 - protein, 7 aa, Artificial Sequence
  Artificial polymer
FSPTDDF

SEQ ID NO: 1033 - protein, 13 aa, Artificial Sequence
  Artificial polymer
KAIPIYGSTAEDY

SEQ ID NO: 1034 - protein, 7 aa, Artificial Sequence
  Artificial polymer
FSLTDDY

SEQ ID NO: 1035 - protein, 8 aa, Artificial Sequence
  Artificial polymer
WTRDRQQY

SEQ ID NO: 1036 - protein, 7 aa, Artificial Sequence
  Artificial polymer
FTRDEDF

SEQ ID NO: 1037 - protein, 14 aa, Artificial Sequence
  Artificial polymer
EVEGSGREGNFYGA

SEQ ID NO: 1038 - protein, 5 aa, Artificial Sequence
  Artificial polymer
PGWDY

SEQ ID NO: 1039 - protein, 8 aa, Artificial Sequence
  Artificial polymer
YDRSATAY

SEQ ID NO: 1040 - protein, 11 aa, Artificial Sequence
  Artificial polymer
ASSVLSGTVDY

SEQ ID NO: 1041 - protein, 8 aa, Artificial Sequence
  Artificial polymer
FAADGMEY

SEQ ID NO: 1042 - protein, 13 aa, Artificial Sequence
  Artificial polymer
KAAASYVSTVADY

SEQ ID NO: 1043 - protein, 6 aa, Artificial Sequence
  Artificial polymer
TAKDDY

SEQ ID NO: 1044 - protein, 9 aa, Artificial Sequence
  Artificial polymer
FTGWGKEDY

SEQ ID NO: 1045 - protein, 8 aa, Artificial Sequence
  Artificial polymer
WAADYQQY

SEQ ID NO: 1046 - protein, 8 aa, Artificial Sequence
  Artificial polymer
YDRSATPY

SEQ ID NO: 1047 - protein, 8 aa, Artificial Sequence
  Artificial polymer
WARDRQQY

SEQ ID NO: 1048 - protein, 7 aa, Artificial Sequence
  Artificial polymer
FTRGDDY

SEQ ID NO: 1049 - protein, 8 aa, Artificial Sequence
  Artificial polymer
WTKDRQQY

SEQ ID NO: 1050 - protein, 7 aa, Artificial Sequence
  Artificial polymer
FTRTYDY

SEQ ID NO: 1051 - protein, 11 aa, Artificial Sequence
  Artificial polymer
ASSILSGTVDY

SEQ ID NO: 1052 - protein, 8 aa, Artificial Sequence
  Artificial polymer
WAADYQQY

SEQ ID NO: 1053 - protein, 13 aa, Artificial Sequence
  Artificial polymer
KPAPVYGSTVGDY

SEQ ID NO: 1054 - protein, 8 aa, Artificial Sequence
  Artificial polymer
FAADGMEY

SEQ ID NO: 1055 - protein, 6 aa, Artificial Sequence
  Artificial polymer
FGSGGG

SEQ ID NO: 1056 - protein, 11 aa, Artificial Sequence
  Artificial polymer
ASSVLSGTADY

SEQ ID NO: 1057 - protein, 7 aa, Artificial Sequence
  Artificial polymer
FTRGDDY

SEQ ID NO: 1058 - protein, 15 aa, Artificial Sequence
  Artificial polymer
EAEGSGREGNFYERS

SEQ ID NO: 1059 - protein, 115 aa, Artificial Sequence
  Artificial polymer
QVQLVESGGGLVHPGGSLRLSCAASGSISSINVMGWYRQAPGKERELVARITNLGLPNYADWLKDRFTISRDNAKNTVYLQMNSLKPEDTAVYYCYLVALSAEYWGQGTQVTVSS

SEQ ID NO: 1060 - protein, 115 aa, Artificial Sequence
  Artificial polymer
QVQLVESGGGLVHPGGSLRLSCAASGSFSSINVMGWYRQAPGKERELVARITNLGLPNYADSVTGRFTISRDNAKNTVYLQMNSLKPEDTAVYYCYLVALKAEYWGQGTQVTVSS

SEQ ID NO: 1061 - protein, 115 aa, Artificial Sequence
  Artificial polymer
QVQLVESGGGLVHRGGSLRLSCAASGSISSINIMGWYRQAPGKERELVARITNIGLPNYADSVKGRFTISRDNAKSTVYLQMNSLNAEDTAVYYCYLVALKAEYWGQGTQVTVSS

SEQ ID NO: 1062 - protein, 115 aa, Artificial Sequence
  Artificial polymer
QVQLVESGGGLVQPGGSLRLSCAASGSISSINVMGWYRQAPGKERELVARITNLGLPNYADSVEGRFTISRDKDENTVYLEMNTLKPEDTAVYYCYLVGLKAEYWGQGTQVTVSS

SEQ ID NO: 1063 - protein, 121 aa, Artificial Sequence
  Artificial polymer
QVQLVESGGGLVQPGGSLRLSCAASGSSDSINAMGWYRQAPGKERELVAAITSGGRVVYSDSVKGRGTISRDNAKNTVYLQIASLKPEDTAVYYCNVKTKSAVLFGGMDYWGKGTQVTVSS

SEQ ID NO: 1064 - protein, 115 aa, Artificial Sequence
  Artificial polymer
QVQLVESGGGLVQPGGSLRLSCAASVSIFSINAMGWYRQAPGKERELVAAITSGGRTAYADSVKGRFTISRDNSKNTVYLQMDSLKPEDTDVYYCKAYIRGEDYWGKGTQVTVSS

SEQ ID NO: 1065 - protein, 115 aa, Artificial Sequence
  Artificial polymer
DVQLVESGGGLVQPGGSLRLSCAASGSIFSLNAMGWYRQAPGKERELVAHITSDGRIVYADPVKGRFTISRVDGKNMVTLQMNSLKPEDTAVYYCNAKHYASNYWGQGTQVTVSS

SEQ ID NO: 1066 - protein, 117 aa, Artificial Sequence
  Artificial polymer
QVQLVESGGGSVQAGGSLRLSCAASGRTISNYDMAWSRQAPGKEREFVARISGSGDRTDYADSVKGRFTISRDNAKNTVYLQMNSLKPEDTAIYYCQIQDFGSPSFSGQGTQVTVSS

SEQ ID NO: 1067 - protein, 117 aa, Artificial Sequence
  Artificial polymer
DVQLVESGGGSVQAGGSLRLSCAASGRTISNYDMAWSRQAPGKEREFVARISGSGDRTDYADSVKGRFTISRDNAKNTVYLQMNSLKPEDTAIYYCQIQDFRSPDFWSQGTQVTVSS

SEQ ID NO: 1068 - protein, 117 aa, Artificial Sequence
  Artificial polymer
QVQLVESGGESVQAGGSLRLSCAASGRTISNYDMAWSRQAPGKEREFVARISGSGDRTDYADSVKGRFTISRDNAKNTVYLQMNSLKPEDTAIYNCQTQIFGSPNFSGQGTQVTVSS

SEQ ID NO: 1069 - protein, 116 aa, Artificial Sequence
  Artificial polymer
QVQLVESGGGLVQAGDSLRLSCAASGRTFTTSLMQWHRQAPGKEREFVASITWSTGNTHYADSVKGRFTISRDNARNTVYLQMNSLKPEDTAIYTCRVLAIHGDYWGQGTQVTVSS

SEQ ID NO: 1070 - protein, 116 aa, Artificial Sequence
  Artificial polymer
DVQLVESGGGLVQAGDSLRLSCAASERNLRIYDMAWYRQAPGKEREYVAVISSSGDSTHYSDFVKGRFTISRDNAKNTVSLQMDSLKPEDTAFYYCNVNQIRQWPWGQGTQVTVSS

SEQ ID NO: 1071 - protein, 116 aa, Artificial Sequence
  Artificial polymer
QVQLVESGGGLVQAGDSLRLSCAASERNLRIYDMAWYRQAPGKEREYVAVISSSGDSTHYSDFVKGRFTISRDNAKNTVSLQMDSLKPEDTAFYYCNVNSIRQWPWGQGTQVTVSS

SEQ ID NO: 1072 - protein, 116 aa, Artificial Sequence
  Artificial polymer
QVQLVESGGGLVQAGDSLRLSCTASERNLRSYDMAWWRQAPGKEREYVAVITSSGDSTHYSDFVKGRFTISRDNAKNTVSLQMDSLKPEDTASYYCNVNAIRQWPWGQGTQVTVSS

SEQ ID NO: 1073 - protein, 117 aa, Artificial Sequence
  Artificial polymer
DVQLVESGGGSVQAGGSLRLSCAISGLTFSNYHMGWYRQAPGREREFVAQITWSDASIYYAGSVKGRFTISRDNVKNIVYLQIDNLKPEDTAIYYCDARKVGGPDYWGQGTQVTVSS

SEQ ID NO: 1074 - protein, 117 aa, Artificial Sequence
  Artificial polymer
QVQLVESGGGLVQAGGSLTLSCAISGLTFSSYHMGWYRQAPGREREFVAQITWSDTSIYYAGSVKGRFTISRDNVKNIVYLQIDNLKPEDTAIYYCDARKVGGPDYWGQGTQVTVSS

SEQ ID NO: 1075 - protein, 117 aa, Artificial Sequence
  Artificial polymer
DVQLVESGGGLVQAGGSLRLSCAISGLTFSRYHMGWYRQAPGREREFVAQITWSDGTTYYPGSVKGRFTISRDNARNTVYLQIDNLKPEDTAIYYCDARKVGGPDYWGQGTQVTVSS

SEQ ID NO: 1076 - protein, 117 aa, Artificial Sequence
  Artificial polymer
QVQLVESGGGLVQAGGSLRLSCATSGLTLSSYYIAWYRQAPGREREFVAQIRWSDDSTYYPGSVKGRFTISRDNARNTVYLRMDNLKPEDTARYYCDARKVGGPDYWGQGTQVTVSS

SEQ ID NO: 1077 - protein, 117 aa, Artificial Sequence
  Artificial polymer
DVQLVESGGGLVQAGGSLRLSCATSGLTFSSYYTGWYRQAPGREREFVAQISWSDDSTYYADSVKGRFTISRDNARNTVYLQMNNLKPGDTAIYYCDARKVGGPDYWGQGTQVTVSS

SEQ ID NO: 1078 - protein, 117 aa, Artificial Sequence
  Artificial polymer
DVQLVESGGGLVQAGGSLRLSCATSGLTLSSYHMGWYRQAPGREREFVAQISWSDDSTYYADSVKGRFTISRDNARNTVYLQMNNLKPEDTAIYYCDARKVGGPDYWGQGTQVTVSS

SEQ ID NO: 1079 - protein, 115 aa, Artificial Sequence
  Artificial polymer
DVQLVESGGGLVQAGGSLRLSCAASGRTSSPYVTGWYRQTPGKEREPVATVSWGGVTYYADSVKGRFTISRDNAKNTVYLQMNALKPEDTAIYYCNVNTFGNVYWGQGTQVTVSS

SEQ ID NO: 1080 - protein, 112 aa, Artificial Sequence
  Artificial polymer
QVQLVESGGGLVQPGGSLRLSCAASGFTFSGYVMSWVRQAPGKGLEWVASIGSGGGYPSYTDSVEGRFTISRDNAKNTLYLLMDNLKPDDTAVYYCEMLGRRGQGTQVTVSS

SEQ ID NO: 1081 - protein, 112 aa, Artificial Sequence
  Artificial polymer
QVQLVESGGGLVQPGGSLRLSCAASGFTFSGYVMSWVRQAPGKGLEWVASIGSGGGYPSYTDSVEGRFTISRDNAKNTLYLQMNNLKPDDTAVYYCEMLGRRGQGTQVTVSS

SEQ ID NO: 1082 - protein, 112 aa, Artificial Sequence
  Artificial polymer
QVQLVESGGGLVQPGGSLRLSCAASGFTFSGYVMSWVRQAPGKGLEWVASIGSGGGYPSYTGSVEGRFTISRDNAKNTLYLLMNNLKPDDTAVYYCEMLGRRGQGTQVTVSS

SEQ ID NO: 1083 - protein, 112 aa, Artificial Sequence
  Artificial polymer
QVQLVESGGGLVQPGGSLRLSCAASGFTFSGYVMSWVRQAPGKGLEWVAHIGSGGGYPSYTDSVQGRFTISRDNAKNTLYLQMNNLKPEDTAVYYCEMLGRRGQGTQVTVSS

SEQ ID NO: 1084 - protein, 112 aa, Artificial Sequence
  Artificial polymer
QVQLVESGGGLVQPGGSLRLSCAASGFTFSGYVMTWVRQAPGKGLEWVAHIGSGGGHATYTDSVEGRFTISRDNAKNTLYLQMNNLKAEDTAVYYCEFLGRRGQGTQVTVSS

SEQ ID NO: 1085 - protein, 112 aa, Artificial Sequence
  Artificial polymer
QVQLVESGGGLVQPGGSLRLSCAASGFTFSGYLMSWVRQAPGKGLEWVATIGSGGGITSYADSVKGRFTISRDNAKNTLYLQMNNLKHEDTAVYYCETVIKRGQGTQVTVSS

SEQ ID NO: 1086 - protein, 134 aa, Artificial Sequence
  Artificial polymer
QVQLQESGGGLVQPGGSLRLSCAASGRISSINSMGWYRQAPGNQRELVAAITNGGAKTYADSVKGRFTISTDNAGNTVYLQMDSLRPEDTAVYYCKAFTRRDDYWGQGTQITVSSAAAYPYDVPDYGSHHHHHH

SEQ ID NO: 1087 - protein, 134 aa, Artificial Sequence
  Artificial polymer
QVQLQESGGGLVQAGGSLRLSCAASGSITSINAMGWYRQAPGKQRELVAAITSGGRLSYADSVKGRFTISRDNAESTVALQMNSLKPEDTAVYSCAAFQSSGIDWGQGTQVTVSSAAAYPYDVPDYGSHHHHHH

SEQ ID NO: 1088 - protein, 135 aa, Artificial Sequence
  Artificial polymer
QVQLQESGGGLVQPGGSLRLSCAASGRFFRVNAMGWYRQAPGKQRELVAAITNGGQTAYADSVKGRFTISKESARNTVHLQMSSLKPEDTAVYYCTIWAADYQQYWGQGTQVTVSSAAAYPYDVPDYGSHHHHHH

SEQ ID NO: 1089 - protein, 135 aa, Artificial Sequence
  Artificial polymer
QVQLQESGGGLVQAGESLRLSCAASGSSDSINAMGWYRQAPGKQRELVAAITSGGRSTYIDSAKGRATISRDNARNTAYLQMSSLKAEDTAVYYCTIWNRDRQQYWGQGTQVTVSSAAAYPYDVPDYGSHHHHHH

SEQ ID NO: 1090 - protein, 140 aa, Artificial Sequence
  Artificial polymer
QVQLQESGGGLVQSGGSLRLSCAASGSVFSINAWGWYRQAPGKQRELVAAITNQGRIAYAPSVNGRFTISRDSAKNTVYLQMNSLKPEDTAVYYCNAKPTPVYGSTVGDYWGQGTQVTVSSAAAYPYDVPDYGSHHHHHH

SEQ ID NO: 1091 - protein, 134 aa, Artificial Sequence
  Artificial polymer
QVQLQESGGGLVQAGGSLRLSCAASGSILSINSMGWYRPALGNQRELVAAITNDGRTTYVDSVKGRFTISRDNAKNTVYLQMNSLKPEDTAVYWCKAFTRDKDYWGQGTQVTVSSAAAYPYDVPDYGSHHHHHH

SEQ ID NO: 1092 - protein, 135 aa, Artificial Sequence
  Artificial polymer
  misc_feature (108)..(108): Xaa can be any naturally occurring amino acid
QVQLQESGGGLVQTGGSLRLSCAASVSISSINSMGWYRQAPGKERELVAAVTVGGRYAYADSAKNRFTISRDDAQNTVHLQMSSLRAEDTAVYYCTIWDRDRQQYWGXGTQVTVSSAAAYPYDVPDYGSHHHHHH

SEQ ID NO: 1093 - protein, 134 aa, Artificial Sequence
  Artificial polymer
QVQLQESGGGLVQPGGSLRLSCAASGRVFSINAMGWYRQAPGKQRELVAAITNQGATTYADSVKGRFTISRDTAGNTVYLQMNSLRPEDTAVHYCKAFTRTDDYWGQGTQVTVSSAAAYPYDVPDYGSHHHHHH

SEQ ID NO: 1094 - protein, 135 aa, Artificial Sequence
  Artificial polymer
QVQLQESGGGLVQAGGSLRLSCAASVNIDTLNSMAWYRQAPGKQRELVAGITGSGQITYANSVRGRFTVSRDNAKSTVYLQMNTLQPEDTAVYYCAAYDRSSTPYWGQGTQVTVSSAAAYPYDVPDYGSHHHHHH

SEQ ID NO: 1095 - protein, 134 aa, Artificial Sequence
  Artificial polymer
QVQLQESGGGLVQPGGSLRLSCAASGGISSINSMGWYRQAPGNQRELVAAITNGGRTVYGDSVKGRFTISRDSAGNTVHLQMDSLRPEDTGVYYCKAFTRGDDYWGQGTQVTVSSAAAYPYDVPDYGSHHHHHH

SEQ ID NO: 1096 - protein, 134 aa, Artificial Sequence
  Artificial polymer
QVQLQESGGGLVQPGGFLSLSCAASGSMHSVNSMAWYRQVPGKQRELVAAITSGGRLAYAPSVNGRFTISRDYAKNTIHLQMNSLEPEDTAVYYCAALNSATTYWGQGTQVTVSSAAAYPYDVPDYGSHHHHHH

SEQ ID NO: 1097 - protein, 134 aa, Artificial Sequence
  Artificial polymer
QVQLQESGGGLVQAGGSLRLSCAATGDISSINAMGWHRPARGNERELVAAITNGGRTTYVDSVKGRFTISRDNAKNTVYLQMNSLKPEDTAVYFCKAYTRDEDYWGQGTQVTVSSAAAYPYDVPDYGSHHHHHH

SEQ ID NO: 1098 - protein, 134 aa, Artificial Sequence
  Artificial polymer
QVQLQESGGGLVRAGGSLRLSCAASGSIFSIDAMGWYRPAHGEQRELVAAITTGGRTTYVDSVKGRFTISRDNAKNTVYLQMNSLKPEDTAVYFCKAFTRDEDYWGQGTQVTVSSAAAYPYDVPDYGSHHHHHH

SEQ ID NO: 1099 - protein, 140 aa, Artificial Sequence
  Artificial polymer
QVQLQESGGGLVQPGGSLRLSCAASGSIFSINAMGWYRQAPGKQRELVAAITNQGRLTYADSVKGRFTISRDNAKNTVFLQMDSLKPEDTAVYYCNAKWYDPLVIEYYDNWGQGTQVTVSSAAAYPYDVPDYGSHHHHHH

SEQ ID NO: 1100 - protein, 134 aa, Artificial Sequence
  Artificial polymer
QVQLQESGGGLVQPGGSLRLSCAASGSIFSIAAMGWYRQAPGKQRELVAAITSGGRRAYADSVKGRFTISRDNDENTVALQMNSLKPEDTDVYYCNAKADHNDYWGQGTQITVSSAAAYPYDVPDYGSHHHHHH

SEQ ID NO: 1101 - protein, 137 aa, Artificial Sequence
  Artificial polymer
QVQLQESGGGLVQPGGSLRLSCAAIGNIASITAMGWYRQAPGKQRELVAAITSASASRTTYADSVKGRFTISRDNAKNTVYLQMNSLQPEDTAVYYCKGFRSGADDYWGQGTQVTVSSAAAYPYDVPDYGSHHHHHH

SEQ ID NO: 1102 - protein, 143 aa, Artificial Sequence
  Artificial polymer
QVQLQESGGGLVQPGGSLRLSCAASGFTFDDYAIGWFRQAPGKEHEGVSCISRSDGSTYYDDSVKGRFTISSDNAKNTVYLQMNSLKPEDTAVYYCAAEVPSTYSCSGFREDYKGKGTQVTVSSAAAYPYDVPDYGSHHHHHH

SEQ ID NO: 1103 - protein, 135 aa, Artificial Sequence
  Artificial polymer
QVQLQESGGGLVQPGGSLRLSCAASGSISSINAMGWYRQAPGNQRELVAAITNQGRVTYADSVKGRFTISRDGAKNTVYLQMNSLKPEDTAVYYCKVFAASGMEYWGKGTQVTVSSAAAYPYDVPDYGSHHHHHH

SEQ ID NO: 1104 - protein, 135 aa, Artificial Sequence
  Artificial polymer
QVQLQESGGGLVQAGESLRLSCAASVSIFRSYFMGWYRQAPGKQRELVAAITDGGRLAYADSAKGRFTISREDTRNTVHLQMSSLKAEDTAVYYCTIWTTDRQQYWGQGTQVTVSSAAAYPYDVPDYGSHHHHHH

SEQ ID NO: 1105 - protein, 136 aa, Artificial Sequence
  Artificial polymer
QVQLQESGGGWVQPGGSLRLSCAATGSIVSINAIGWYRQAPGKQRELVASITNQGIRNYSTSVMGRFTISRDDVKNTVSLQMNSLKPEDSAVYYCKGFAGWGKEDYWGQGTQVTVSSAAAYPYDVPDYGSHHHHHH

SEQ ID NO: 1106 - protein, 134 aa, Artificial Sequence
  Artificial polymer
QVQLQESGGGLVQAGASLRLSCAASGSIFSINAMGWYRQAPGKQRELVAAITNQGRTTYADSVKGRFTISRDNAKNTVYLQMDSLEPEDTAIYYCKGFSPTGDYWGQGTQVTVSSAAAYPYDVPDYGSHHHHHH

SEQ ID NO: 1107 - protein, 140 aa, Artificial Sequence
  Artificial polymer
QVQLQESGGGLVQPGGSLRLSCLASRSFSSFNAMGWYRQAPGKERELVAAITNGGRIAYGIAVNGRFTISRDNAKNTVYLQMNSLKPEDTAVYYCNAKPTPVYGSTVGDYWGQGTQVTVSSAAAYPYDVPDYGSHHHHHH

SEQ ID NO: 1108 - protein, 140 aa, Artificial Sequence
  Artificial polymer
QVQLQESGGGLVQAGGSLTLSCAASGSFSSINAMGYYRQAPGKQRELVAAITNGGRIAYSDSAKGRFTISRDSAKNTMYLQMNSLKPEDTDVYYCNAKASPVYGSTVEDYWGQGTQVTVSSAAAYPYDVPDYGSHHHHHH

SEQ ID NO: 1109 - protein, 135 aa, Artificial Sequence
  Artificial polymer
QVQLQESGGGLVQPGGSLRLSCAASGTSFSINGMAWYRQAPGGQRELVGGITSDGSTGYADSVKGRFTVSRDNAKNTVYLQMNRLKPEDTAVYYCGTSTPRGDSYWGQGTQVTVSSAAAYPYDVPDYGSHHHHHH

SEQ ID NO: 1110 - protein, 145 aa, Artificial Sequence
  Artificial polymer
QVQLQESGGGLVQAGGSLRLSCAASGRTFSTYAMGWFRQAPGKERGLVAAISWSGGSTYYADSVKGRFTIFRDNAENTVYLQMNSLKPEDTAVYYCAAEAEGSGREGNFYERSWYQGQGTQVTVSSAAAYPYDVPDYGSHHHHHH

SEQ ID NO: 1111 - protein, 135 aa, Artificial Sequence
  Artificial polymer
QVQLQESGGGLVETGGSLRLSCAASGSIFSINAMGWYRQAPGKQRELVAAITDQGRLAYADSAKGRFTISRENARNTLHLQMSSLKAEDTAVYYCTIWDRDRQQYWGQGTQVTVSSAAAYPYDVPDYGSHHHHHH

SEQ ID NO: 1112 - protein, 134 aa, Artificial Sequence
  Artificial polymer
QVQLQESGGGLVQPGGSLRLSCAASGRIFDINAMGWYRQAPGKQRELVAAITNGGQTTYADSVKGRFTISRDNAGNTVYLQMNSLRPEDTAVYYCKAFTRSDDYWGQGTQVTVSSAAAYPYDVPDYGSHHHHHH

SEQ ID NO: 1113 - protein, 135 aa, Artificial Sequence
  Artificial polymer
QVQLQESGGGLVQAGGSLRLSCAASGTLFSINGMAWYRQAPGKRRELVGGITSDGSTGYADSVKGRFTISRDNAKNTAYLQMNSLKPEDTAVYYCGTSTPRGDSYWGQGTQVTVSSAAAYPYDVPDYGSHHHHHH

SEQ ID NO: 1114 - protein, 134 aa, Artificial Sequence
  Artificial polymer
QVQLQESGGGLVQAGGSLRLSCAASGSIDSINAMGWYRPALGEQRELVAAITTGGRTAYVDSVKGRFTISRDAAKNTVYLQMNSLKPEDTAVYSCKAFTRDTDYWGQGTQVTVSSAAAYPYDVPDYGSHHHHHH

SEQ ID NO: 1115 - protein, 134 aa, Artificial Sequence
  Artificial polymer
QVQLQESGGGLAQPGGSLQLSCAASGRAFSTNSMGWYRQASGKQRELVAAITSQGRITLADSVKGRFTISSDNTKNTVFLQMNSLKPEDTAVYYCNAWTTLGTFGGQGTQVTVSSAAAYPYDVPDYGSHHHHHH

SEQ ID NO: 1116 - protein, 136 aa, Artificial Sequence
  Artificial polymer
QVQLQESGGGLVQTGESLSLSCAVASGSIISINSMGWYRQAPEKQRELVAAITVDGRLAYADSAKHRFTISKESARNTVHLHMSSLKPEDTAVYYCTIWVRDGQQYWGQGTQVTVSSAAAYPYDVPDYGSHHHHHH

SEQ ID NO: 1117 - protein, 140 aa, Artificial Sequence
  Artificial polymer
QVQLQESGGGLVQPGGSLRLSCAVSRNFFSINAMGWYRQAPGKQRELVAAITNGGRIAYGTSVMGRFTISRDDAKNTVDLQMNSLRPEDTAVYYCNAKAIPVYGSTVEDYWGQGTQVTVSSAAAYPYDVPDYGSHHHHHH

SEQ ID NO: 1118 - protein, 140 aa, Artificial Sequence
  Artificial polymer
QVQLQESGGGLVQPGGSLRLSCAASGRFFRVNAMGWYRQVPGKQRELVAAITNGGQIAYADSVKGRFTISRDSAKNTVYLQMNSLKSEDTDVYYCNAKAAATHLSTVADYWGQGTQVTVSSAAAYPYDVPDYGSHHHHHH

SEQ ID NO: 1119 - protein, 136 aa, Artificial Sequence
  Artificial polymer
QVQLQESGGGLVQPGGSLRLSCAASGSIVSINSMGWYRQAPGKQRELVAAITDQGRTTYADSVKGRFTISRDDAKNKNTVYLQMNSLKAEDTAVYACKAFGRFDDYWGQGTQVTVSSAAAYPYDVPDYGSHHHHHH

SEQ ID NO: 1120 - protein, 141 aa, Artificial Sequence
  Artificial polymer
QVQLQESGGGLVQPGGSLRLSCAAYGSIFSINAMGWYRQAPGKERELVAGITTQGRITYGNSVRGRFTISGDNAKNTVYLQMKSLKPEDTAVYYCSAWGVKTGPESGSGTLEGQGTQVTVSSAAAYPYDVPDYGSHHHHHH

SEQ ID NO: 1121 - protein, 134 aa, Artificial Sequence
  Artificial polymer
QVQLQESGGGLVQAGGSLRLSCAASGSIIGINSMGYYRTAPGKQRELVAAITSGGRTTYVDSVKGRFTISRDNAKNTVYLQMNSLKPEDTAVYFCKAFTRDEDYWGQGTQVTVSSAAAYPYDVPDYGSHHHHHH

SEQ ID NO: 1122 - protein, 138 aa, Artificial Sequence
  Artificial polymer
QVQLQESGGGLVQAGGSLRLSCAASGRTFPGYVMAWFRQSPGQEREFAAAINWRGGDTYYADSVKGRFTISRDNVKNTVFLQMNSLKPEDTAVYFCAARLTTEYDYAYWGQGTQVTVSSAAAYPYDVPDYGSHHHHHH

SEQ ID NO: 1123 - protein, 134 aa, Artificial Sequence
  Artificial polymer
QVQLQESGGGLVQPGESLRLSCAASGSIFSINAMGWYRQAPGKQRELVAAITDGGAKTYADSVKGRFTISTDNAGNTVYLQMDSLRPEDTAVYYCKAFTRGNDYWGQGTQVTVSSAAAYPYDVPDYGSHHHHHH

SEQ ID NO: 1124 - protein, 134 aa, Artificial Sequence
  Artificial polymer
QVQLQESGGGLVQAGESLRLSCVVSGRTFSINAMGWYRQAPGKQRELVAAITNQGRLSYVDSVKGRFTISRDNAANTVYLQMNSLKPEDTAVYYCAAFQSSGIDWGQGTQVTVSSAAAYPYDVPDYGSHHHHHH

SEQ ID NO: 1125 - protein, 134 aa, Artificial Sequence
  Artificial polymer
QVQLQESGGGLVQAGGSLRLSCAASGRTLSSYTIGWYRQAPGKQRELVAAITNQGRRTYADSVKGRFTISRDNAKNTVYLQMDSLKSEDTAVYYCKGFSPTDDFWGQGTQVTVSSAAAYPYDVPDYGSHHHHHH

SEQ ID NO: 1126 - protein, 140 aa, Artificial Sequence
  Artificial polymer
QVQLQESGGGLVQPGGSLRLSCTASGSFFSINAMGWYRQAPGNQRELVAAITNGGRIAYTDSVKGRFTISNDNAKNTVYLQMNSLKPEDTDVYYCNAKAIPIYGSTAEDYWGQGTQVTVSSAAAYPYDVPDYGSHHHHHH

SEQ ID NO: 1127 - protein, 134 aa, Artificial Sequence
  Artificial polymer
QVQLQESGGGLVQAGGSLRLSCAASGSIFSINSMGWYRQAPGKQRELVAAITNGGRTTYADSVKGRFTISRDNAKNTVYLQMDSLKPEDTAVYYCKGFSLTDDYWGQGTQVTVSSAAAYPYDVPDYGSHHHHHH

SEQ ID NO: 1128 - protein, 135 aa, Artificial Sequence
  Artificial polymer
QVQLQESGGGLVQTGGSLRLSCAASGSIFSFNAMGWYRQAPGKQRELVAAITDGGRLTYADSAKGRFTISRENTRNTVHLQMSSLKAEDTADYYCTIWTRDRQQYWGQGTQVTVSSAAAYPYDVPDYGSHHHHHH

SEQ ID NO: 1129 - protein, 134 aa, Artificial Sequence
  Artificial polymer
QVQLQESGGGLVQAGGSLRLSCAASGSIFSINAMGWYRPALGEQRELVAAITTGGRTTYVDSVKGRFSISRDNAKNTVYLQMNSLKPEDTAVYFCKAFTRDEDFWGQGTQVTVSSAAAYPYDVPDYGSHHHHHH

SEQ ID NO: 1130 - protein, 145 aa, Artificial Sequence
  Artificial polymer
QVQLQESGGGLVQAGGSLRLSCEASGRTFSTYAMAWFRQAPGKERDLVAAISWSGGSTEYHDSVKGRFTISRDNTKNTVYLQMNSLKAEDTAVYYCAAEVEGSGREGNFYGASWYPGQGTQVTVSSAAAYPYDVPDYGSHHHHHH

SEQ ID NO: 1131 - protein, 132 aa, Artificial Sequence
  Artificial polymer
QVQLQESGGGLVQPGGSLRLSCAASGSFFSINAMGWYRQAPGKQRELVAAITNQGRIAYADSVKGRFTISRDNAKNTVYLQMNSLKPEDTAVYYCGRPGWDYWGQGTQVTVSSAAAYPYDVPDYGSHHHHHH

SEQ ID NO: 1132 - protein, 135 aa, Artificial Sequence
  Artificial polymer
QVQLQESGGGLVQAGGSLRLSCVASVNIGSLNSMVWYRQSPGKQRELVAGITGSGQITYANSVRGRFTVSRDIAKSTAYLQMNTLKPEDTAVYYCAAYDRSATAYWGQGTQVTVSSAAAYPYDVPDYGSHHHHHH

SEQ ID NO: 1133 - protein, 139 aa, Artificial Sequence
  Artificial polymer
QVQLQESGGGLVQAGGSLRVSCAASGRTLSNYAVGWWRQAPGKQREFVAAINWSSGGISYSNSAKGRFALSRDNAKNTVYLQMDSLKPEDTAVYYCAAASSVLSGTVDYWGQGTQVTVSSAAAYPYDVPDYGSHHHHHH

SEQ ID NO: 1134 - protein, 135 aa, Artificial Sequence
  Artificial polymer
QVQLQESGGGLVQPGGSLRLSCAASGSISSINAMGWYRQAPGKQRELVAAITGQGRTTYADSVKGRFTISRDGAKNTVYLQMNSLKPEDTAVYYCKVFAADGMEYWGKGTQVTVSSAAAYPYDVPDYGSHHHHHH

SEQ ID NO: 1135 - protein, 140 aa, Artificial Sequence
  Artificial polymer
QVQLQESGGGLVQPGGSLRLSCAASGRFFRVNAMGWYRQAPGKQRELVAAITNGGQIVYADSVKGRFTISRDSAKNTVYLQMNSLKSEDTAVYYCNAKAAASYVSTVADYWGQGTQVTVSSAAAYPYDVPDYGSHHHHHH

SEQ ID NO: 1136 - protein, 134 aa, Artificial Sequence
  Artificial polymer
QVQLQESGGGLVQAGGSLRLSCAASGSVFSINAMGWYRQAPEKQRELVAAITTQGRTTYEDSVKGRFTISRDGAQNTVYLQMDSLKPEDTAVYYCKAWTAKDDYWGKGTQVTVSSAAAYPYDVPDYGSHHHHHH

SEQ ID NO: 1137 - protein, 136 aa, Artificial Sequence
  Artificial polymer
QVQLQESGGGRVQPGGSLRLSCAAIGSIFEINSIGWYRQAPGKQRELVAAITSGGITNYANSVQGRSTISRDNVNNTVYLQMNSLKPEDSAVYYCKGFTGWGKEDYWGQGTQVTVSSAAAYPYDVPDYGSHHHHHH

SEQ ID NO: 1138 - protein, 135 aa, Artificial Sequence
  Artificial polymer
QVQLQESGGGLVQTGGSLRLSCAASGSIFNINSMGWYRQAPGKQRELVAAITVGGRLAYADSAKGRFTISKESARNTVHLQMSSLKPEDTAVYYCTIWAADYQQYWGQGTQVTVSSAAAYPYDVPDYGSHHHHHH

SEQ ID NO: 1139 - protein, 135 aa, Artificial Sequence
  Artificial polymer
QVQLQESGGGLVQAGGSLRLSCAASVNIGTLNSMAWYREAPGKQRELVAGITGGGQITYANSVRGRFTVSRDIAKSTAYLQMNTLKPEDTAVYYCAAYDRSATPYWGQGTQVTVSSAAAYPYDVPDYGSHHHHHH

SEQ ID NO: 1140 - protein, 135 aa, Artificial Sequence
  Artificial polymer
QVQLQESGGGLVQTGGSLRLSCAASGSIFSINSMGWYRQAPGKQRELVAAITSQGRSTYADSAKGRFTISLGNARNTVNLQMSSLKTEDTAVYYCTIWARDRQQYWGQGTQVTVSSAAAYPYDVPDYGSHHHHHH

SEQ ID NO: 1141 - protein, 134 aa, Artificial Sequence
  Artificial polymer
QVQLQESGGGLVQPGGSLRLSCAASGRIGSINSMGWYRQAPGKQREMVAAITNGGATVYADSVKGRFTISRDNAGNTVDLHMNSLRPEDSAVYYCKAFTRGDDYWGQGTQVTVSSAAAYPYDVPDYGSHHHHHH

SEQ ID NO: 1142 - protein, 135 aa, Artificial Sequence
  Artificial polymer
QVQLQESGGGLVQPGGSLKLSCAASGSIFSFNAMGWYRQAPGKQRELVAAITDGGRLTYADSAKNRFTISRENTRNTVHLQMSSLKAEDTAVYYCTIWTKDRQQYWGQGTQVTVSSAAAYPYDVPDYGSHHHHHH

SEQ ID NO: 1143 - protein, 134 aa, Artificial Sequence
  Artificial polymer
QVQLQESGGGLVQPGGSLRLSCAASGRISSINSMGWYRQAPGKQRELVAAITNGGAKTYADSVKGRFTISRDGAGNTVYLQMDNLRPEDTAVYYCKAFTRTYDYWGQGTQVTVSSAAAYPYDVPDYGSHHHHHH

SEQ ID NO: 1144 - protein, 139 aa, Artificial Sequence
  Artificial polymer
QVQLQESGGGLVQAGGSLRVSCAASGRTLSNYAVAWFRQAPGKQREFVAAINWSSGGISYSNAAKGRFALSRDNAKNTVYLQMDSLKPEDTAVYYCAAASSILSGTVDYWGQGTQVTVSSAAAYPYDVPDYGSHHHHHH

SEQ ID NO: 1145 - protein, 135 aa, Artificial Sequence
  Artificial polymer
QVQLQESGGGLVQPGGSLRLSCAASGRIGSINSMGWYRQAPGKQREMVAAITNGGATVYADSVKGRFTISRDNAGNTVDLHMNSLRPEDSAVYYCTIWAADYQQYWGQGTQVTVSSAAAYPYDVPDYGSHHHHHH

SEQ ID NO: 1146 - protein, 140 aa, Artificial Sequence
  Artificial polymer
QVQLQESGGGLVQPGGSLRLSCAASRSFFSFNAMGWYRQAPGKQRELVAAITNGGRIAYGTSVMGRFTISRDNAKNTVYLQMDSLKPEDTAVYYCNAKPAPVYGSTVGDYWGQGTQVTVSSAAAYPYDVPDYGSHHHHHH

SEQ ID NO: 1147 - protein, 135 aa, Artificial Sequence
  Artificial polymer
QVQLQESGGGLVQPGGSPRLSCAASGRFFRVNAMGWYRQAPGKQRELVAAITNGGQTAYADSVKGRFTISRDSAKNTVYLQMNSLKSEDTAVYYCKVFAADGMEYWGKGTQVTVSSAAAYPYDVPDYGSHHHHHH

SEQ ID NO: 1148 - protein, 133 aa, Artificial Sequence
  Artificial polymer
  misc_feature (54)..(54): Xaa can be any naturally occurring amino acid
QVQLQESGGGLVQPGESLRLSCAASGIIFSINAMGWYRQAPGKQRELVAAITNXGRTTYADSVKGRFTISRDNAKNTVTLQMNSLKPEDTAVYYCNAFGSGGGVGQGTQVTVSSAAAYPYDVPDYGSHHHHHH

SEQ ID NO: 1149 - protein, 139 aa, Artificial Sequence
  Artificial polymer
QVQLQESGGGLVQAGGSLRLSCAASGRTLSNYAVAWFRQAPGKQRELVAAIWWASGGISYANSAKGRFVLSRDNAKNTVYLQMDSLKPEDTAVYYCAAASSVLSGTADYWGQGTQVTVSSAAAYPYDVPDYGSHHHHHH

SEQ ID NO: 1150 - protein, 134 aa, Artificial Sequence
  Artificial polymer
QVQLQESGGGLVQPGGSLRLSCAASGRIFSVNAMGWYRQAPGKQRELVAAITNQGAPTYADSVKGRFTISRDNAGNTVYLQMNSLRPEDTAVYYCKAFTRGDDYWGQGTQVTVSSAAAYPYDVPDYGSHHHHHH

SEQ ID NO: 1151 - protein, 145 aa, Artificial Sequence
  Artificial polymer
QVQLQESGGGSVQAGGSLRLSCAASGRTFSSYAMAWFRQAPGMERELVAAISWSGGSTYYADSVKGRFTISRDNAENTVYLQMNSLKPEDTAVYYCAAEAEGSGREGNFYERSWYQGQGTQVTVSSAAAYPYDVPDYGSHHHHHH

SEQ ID NO: 1152 - protein, 115 aa, Artificial Sequence; identical to SEQ ID NO: 1060
  Artificial polymer

SEQ ID NO: 1153 - protein, 115 aa, Artificial Sequence
  Artificial polymer
DVQLVESGGGLVHPGGSLRLSCAASGSFSSINVMGWYRQAPGKERELVARITNLGLPNYADSVTGRFTISRDNSKNTVYLQMNSLRPEDTAVYYCYLVALKAEYWGQGTLVTVSS

SEQ ID NO: 1154 - protein, 115 aa, Artificial Sequence
  Artificial polymer
DVQLVESGGGLVQPGGSLRLSCAASGSFSSINVMGWYRQAPGKERELVARITNLGLPNYADSVTGRFTISRDNSKNTVYLQMNSLRPEDTAVYYCYLVALKAEYWGQGTLVTVSS

SEQ ID NO: 1155 - protein, 115 aa, Artificial Sequence
  Artificial polymer
DVQLVESGGGLVHPGGSLRLSCAASGSFSSINVMGWYRQAPGKERELVARITNLGLPNYADSVKGRFTISRDNSKNTVYLQMNSLRPEDTAVYYCYLVALKAEYWGQGTLVTVSS

SEQ ID NO: 1156 - protein, 115 aa, Artificial Sequence
  Artificial polymer
DVQLVESGGGLVQPGGSLRLSCAASGSFSSINVMGWYRQAPGKERELVARITNLGLPNYADSVKGRFTISRDNSKNTVYLQMNSLRPEDTAVYYCYLVALKAEYWGQGTLVTVSS

SEQ ID NO: 1157 - protein, 115 aa, Artificial Sequence
  Artificial polymer
QVQLQESGGGLVQPGGSLRLSCAASGRIFSVNAMGWYRQAPGKQRELVAAITNQGAPTYADSVKGRFTISRDNAGNTVYLQMNSLRPEDTAVYYCKAFTRGDDYWGQGTQVTVSS

SEQ ID NO: 1158 - protein, 115 aa, Artificial Sequence
  Artificial polymer
DVQLVESGGGLVQPGGSLRLSCAASGRIFSVNAMGWYRQAPGKQRELVAAITNQGAPTYADSVKGRFTISRDNAGNTVYLQMNSLRPEDTAVYYCKAFTRGDDYWGQGTLVTVSS

SEQ ID NO: 1159 - protein, 115 aa, Artificial Sequence
  Artificial polymer
DVQLVESGGGLVQPGGSLRLSCAASGRIFSVNAMGWYRQAPGKQRELVAAITNQGAPTYADSVKGRFTISRDNSGNTVYLQMNSLRPEDTAVYYCKAFTRGDDYWGQGTLVTVSS

SEQ ID NO: 1160 - protein, 115 aa, Artificial Sequence
  Artificial polymer
DVQLVESGGGLVQPGGSLRLSCAASGRIFSVNAMGWYRQAPGKQRELVAAITNQGAPTYADSVKGRFTISRDNAKNTVYLQMNSLRPEDTAVYYCKAFTRGDDYWGQGTLVTVSS

SEQ ID NO: 1161 - protein, 115 aa, Artificial Sequence
  Artificial polymer
DVQLVESGGGLVQPGGSLRLSCAASGRIFSVNAMGWYRQAPGKQRELVAAITNQGAPTYADSVKGRFTISRDNSKNTVYLQMNSLRPEDTAVYYCKAFTRGDDYWGQGTLVTVSS

SEQ ID NO: 1162 - protein, 3 aa, Artificial Sequence
  Synthetic polypeptide
GGS

SEQ ID NO: 1163 - protein, 6 aa, Artificial Sequence
  Artificial polymer
GGSGGS

SEQ ID NO: 1164 - protein, 9 aa, Artificial Sequence
  Artificial polymer
GGSGGSGGS

SEQ ID NO: 1165 - protein, 12 aa, Artificial Sequence
  Artificial polymer
GGSGGSGGSGGS

SEQ ID NO: 1166 - protein, 15 aa, Artificial Sequence
  Artificial polymer
GGSGGSGGSGGSGGS

SEQ ID NO: 1167 - protein, 18 aa, Artificial Sequence
  Artificial polymer
GGSGGSGGSGGSGGSGGS

SEQ ID NO: 1168 - protein, 21 aa, Artificial Sequence
  Artificial polymer
GGSGGSGGSGGSGGSGGSGGS

SEQ ID NO: 1169 - protein, 24 aa, Artificial Sequence
  Artificial polymer
GGSGGSGGSGGSGGSGGSGGSGGS

SEQ ID NO: 1170 - protein, 27 aa, Artificial Sequence
  Artificial polymer
GGSGGSGGSGGSGGSGGSGGSGGSGGS

SEQ ID NO: 1171 - protein, 30 aa, Artificial Sequence
  Artificial polymer
GGSGGSGGSGGSGGSGGSGGSGGSGGSGGS

SEQ ID NO: 1172 - protein, 33 aa, Artificial Sequence
  Artificial polymer
GGSGGSGGSGGSGGSGGSGGSGGSGGSGGSGGS

SEQ ID NO: 1173 - protein, 36 aa, Artificial Sequence
  Artificial polymer
GGSGGSGGSGGSGGSGGSGGSGGSGGSGGSGGSGGS

SEQ ID NO: 1174 - protein, 39 aa, Artificial Sequence
  Artificial polymer
GGSGGSGGSGGSGGSGGSGGSGGSGGSGGSGGSGGSGGS

SEQ ID NO: 1175 - protein, 42 aa, Artificial Sequence
  Artificial polymer
GGSGGSGGSGGSGGSGGSGGSGGSGGSGGSGGSGGSGGSGGS

SEQ ID NO: 1176 - protein, 45 aa, Artificial Sequence
  Artificial polymer
GGSGGSGGSGGSGGSGGSGGSGGSGGSGGSGGSGGSGGSGGSGGS

SEQ ID NO: 1177 - protein, 48 aa, Artificial Sequence
  Artificial polymer
GGSGGSGGSGGSGGSGGSGGSGGSGGSGGSGGSGGSGGSGGSGGSGGS

SEQ ID NO: 1178 - protein, 51 aa, Artificial Sequence
  Artificial polymer
GGSGGSGGSGGSGGSGGSGGSGGSGGSGGSGGSGGSGGSGGSGGSGGSGGS

SEQ ID NO: 1179 - protein, 54 aa, Artificial Sequence
  Artificial polymer
GGSGGSGGSGGSGGSGGSGGSGGSGGSGGSGGSGGSGGSGGSGGSGGSGGSGGS

SEQ ID NO: 1180 - protein, 57 aa, Artificial Sequence
  Artificial polymer
GGSGGSGGSGGSGGSGGSGGSGGSGGSGGSGGSGGSGGSGGSGGSGGSGGSGGSGGS

SEQ ID NO: 1181 - protein, 60 aa, Artificial Sequence
  Artificial polymer
GGSGGSGGSGGSGGSGGSGGSGGSGGSGGSGGSGGSGGSGGSGGSGGSGGSGGSGGSGGS

SEQ ID NO: 1182 - protein, 45 aa, Artificial Sequence
  Artificial polymer
GGGGSGGGGSGGGGSGGGGSGGGGSGGGGSGGGGSGGGGSGGGGS

SEQ ID NO: 1183 - protein, 50 aa, Artificial Sequence
  Artificial polymer
GGGGSGGGGSGGGGSGGGGSGGGGSGGGGSGGGGSGGGGSGGGGSGGGGS

SEQ ID NO: 1184 - protein, 55 aa, Artificial Sequence
  Artificial polymer
GGGGSGGGGSGGGGSGGGGSGGGGSGGGGSGGGGSGGGGSGGGGSGGGGSGGGGS

SEQ ID NO: 1185 - protein, 60 aa, Artificial Sequence
  Artificial polymer
GGGGSGGGGSGGGGSGGGGSGGGGSGGGGSGGGGSGGGGSGGGGSGGGGSGGGGSGGGGS

SEQ ID NO: 1186 - protein, 65 aa, Artificial Sequence
  Artificial polymer
GGGGSGGGGSGGGGSGGGGSGGGGSGGGGSGGGGSGGGGSGGGGSGGGGSGGGGSGGGGSGGGGS

SEQ ID NO: 1187 - protein, 70 aa, Artificial Sequence
  Artificial polymer
GGGGSGGGGSGGGGSGGGGSGGGGSGGGGSGGGGSGGGGSGGGGSGGGGSGGGGSGGGGSGGGGSGGGGS

SEQ ID NO: 1188 - protein, 75 aa, Artificial Sequence
  Artificial polymer
GGGGSGGGGSGGGGSGGGGSGGGGSGGGGSGGGGSGGGGSGGGGSGGGGSGGGGSGGGGSGGGGSGGGGSGGGGS

SEQ ID NO: 1189 - protein, 80 aa, Artificial Sequence
  Artificial polymer
GGGGSGGGGSGGGGSGGGGSGGGGSGGGGSGGGGSGGGGSGGGGSGGGGSGGGGSGGGGSGGGGSGGGGSGGGGSGGGGS

SEQ ID NO: 1190 - protein, 85 aa, Artificial Sequence
  Artificial polymer
GGGGSGGGGSGGGGSGGGGSGGGGSGGGGSGGGGSGGGGSGGGGSGGGGSGGGGSGGGGSGGGGSGGGGSGGGGSGGGGSGGGGS

SEQ ID NO: 1191 - protein, 90 aa, Artificial Sequence
  Artificial polymer
GGGGSGGGGSGGGGSGGGGSGGGGSGGGGSGGGGSGGGGSGGGGSGGGGSGGGGSGGGGSGGGGSGGGGSGGGGSGGGGSGGGGSGGGGS

SEQ ID NO: 1192 - protein, 95 aa, Artificial Sequence
  Artificial polymer
GGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGS

SEQ ID NO: 1193 - protein, 100 aa, Artificial Sequence
  Artificial polymer
GGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGS

SEQ ID NO: 1194 - DNA, 20 bp, Artificial Sequence
  Artificial polymer
ttatgcttccggctcgtatg

SEQ ID NO: 1195 - DNA, 29 bp, Artificial Sequence
  Artificial polymer
gatgtgcagctgcaggagtctggrggagg

SEQ ID NO: 1196 - DNA, 34 bp, Artificial Sequence
  Artificial polymer
ctagtgcggccgctgaggagacggtgacctgggt

SEQ ID NO: 1197 - DNA, 22 bp, Artificial Sequence
  Artificial polymer
tcacacaggaaacagctatgac

SEQ ID NO: 1198 - DNA, 24 bp, Artificial Sequence
  Artificial polymer
cgccagggttttcccagtcacgac

SEQ ID NO: 1199 - DNA, 432 bp, Artificial Sequence
  Artificial polymer
caggtgcagctgcaggagtctggaggaggtgtggtgcaggctggggactctctgagactctcctgtgtagcctctggacgcaccttcagcagtcttgacatgggttggttccgccaggctccaggaaaggagcgtgagtttgtagcaggtattagccggagtggtattagccaatactatgcagactccatgaagggccgattcaccatctccagagacaacgccaagaacctggtgtatctgcaaatgaacagcctgaaacctgaggacacggccgtttattactgtgcagcagccctgacctttaggggctctgacctcccacgtgatagtaactactggggccaggggacccaggtcaccgtctcctcagcggccgcatacccgtacgacgttccggactacggttcccaccaccatcaccatcactag

SEQ ID NO: 1200 - DNA, 432 bp, Artificial Sequence
  Artificial polymer
caggtgcagctgcaggagtctgggggaggtgtggtgcaggctggggactctctgaaactctcctgtgtagcctctggacgcaccttcagcagtcttgacatgggctggttccgccaggctccaggaaaggagcgtgagtttgtagcaggtattagccggagtggtattagccaatactatgcagactccatgaagggccgattcaccatctccagagacaacgccaagaacctggtgtatctgcaaatgaacagcctgaaacctgaggacacggccgtttattactgtgcagcagccctgacctttaggggctccgacctcccacgtgatagtaactactggggccaggggacccaggtcaccgtctcctcagcggccgcatacccgtacgacgttccggactacggttcccaccaccatcaccatcactag

SEQ ID NO: 1201 - DNA, 432 bp, Artificial Sequence
  Artificial polymer
caggtgcagctgcaggagtctgggggaggtgtggtgcaggctggggactctctgagactctcctgtgtagcctctggacgcaccttcagcagtcttgacatgggctggttccgccagactccaggaaaggagcgtgagtttgtagcaggtattagccggagtggtattagccaatactatgcagactccatgaagggccgattcaccatctccagagacaacgccaagaacctggtgtatctgcaaatgaacagcctgaaacctgaggacacggccgtttattactgtgcagcagccctgacctttaggggctccgacctcccacgtgatagtaactactggggccaggggacccaggtcaccgtctcctcagcggccgcatacccgtacgacgttccggactacggttcccaccaccatcaccatcactag

SEQ ID NO: 1202 - DNA, 432 bp, Artificial Sequence
  Artificial polymer
caggtgcagctgcaggagtctggaggaggattggtgcagcctggggactctctgagactctcctgtgtagcctctggacgcaccttcagcagtcttgacatgggctggttccgccaggctccaggaaaggagcgttagtttgtagcaggtattagccggagtggtattagccaatactatgcagactccatgaagggccgattcaccatctccagagacaacgccaagaacctggtgtatctgcaaatgaacagcctgaaacctgaggacacggccgtttattactgtgcagcagccctgacctttaggggctccgacctcccacgtgatagtaactactggggccaggggacccaggtcaccgtctcctcagcggccgcatacccgtacgacgttccggactacggttcccaccaccatcaccatcactag

SEQ ID NO: 1203 - DNA, 432 bp, Artificial Sequence
  Artificial polymer
caggtgcagctgcaggagtctgggggaggtgtggtgcaggctggggactctctgagactctcctgtgtagcctctggacgcaccttcagcagtcttgacatgggctggttccgccaggctccaggaaaggagcgtgagtttgtagcaggtattagccggagtggtattagccaatactatgcagactccatgaggggccgattcaccatctccagagacaacgccaagaacctggtgtatctgcaaatgaacagcctgaaacctgaggacacggccgtttattactgtgcagcagccctgacctttaggggctccgacctcccacgtgatagtaactactggggccaggggacccaggtcaccgtctcctcagcggccgcatacccgtacgacgttccggactacggttcccaccaccatcaccatcactag

SEQ ID NO: 1204 - DNA, 432 bp, Artificial Sequence
  Artificial polymer
caggtgcagctgcaggagtctgggggaggtgtggtgcaggctggggactctctgagactctcctgtgtagcctctggacgcaccttcagcagtcttgacatgggctggttccgccaggctccaggaaaggagcgtgagtttgtagcaggtattagccggacaggtattagcgcatattatgcagactccatgaagggccgattcaccatctccagagacaacgccaagaacctggtgtatctgcaaatgaacagtttgaaatctgaggacacggccgtttattactgtgcagcagccctgacctttaggggctccgacctcccacgtgatagtaactactggggccaggggacccaggtcaccgtctcctcagcggccgcatacccgtacgacgttccggactacggttcccaccaccatcaccatcactag

SEQ ID NO: 1205 - DNA, 432 bp, Artificial Sequence
  Artificial polymer
caggtgcagctgcaggagtctggaggaggcttggtgcagcctgggggttctctgagactctcctgtgcagcctctggattcaccttcggaggctatgacatgggctggttccgccaggctccaggaaaggagcgtgagtttgtagcaggtattagccggagtggtattagccaatactatgcagactccatgaagggccgattcaccatctccagagacaacgccaagaacctggtgtatctgcaaatgaacagcctgaaacctgaggacacggccgtttattactgtgcagcagccctgacctttaggggctccgacctcccacgtgatagtaactactggggccaggggacccaggtcaccgtctcctcagcggccgcatacccgtacgacgttccggactacggttcccaccaccatcaccatcactag

SEQ ID NO: 1206 - DNA, 432 bp, Artificial Sequence
  Artificial polymer
caggtgcagctgcaggagtctgggggaggtgtggtgcaggctggggactctctgagactctcctgtgtagcctctggacgcaccttcagcagtcttgacatgggctggttccgccaggctccaggaaaggagcgtgagtttgtagcaggtattagccggagtggtattagccaatactatgcagactccatgaagggccgattcaccatctccagagacaacgccaagagcctggtgtatctgcaaatgaacagcctgaaacctgaggacacggccgtttattactgtgcagcagccctgacctttaggggctccgacctcccacgtgatagtaactactggggccaggggacccaggtcaccgtctcctcagcggccgcatacccgtacgacgttccggactacggttcccaccaccatcaccatcactag

SEQ ID NO: 1207 - DNA, 432 bp, Artificial Sequence
  Artificial polymer
caggtgcagctgcaggagtctggaggaggcttggtgcaggctggggggtctctgagactctcctgtacagcctctggacgcaccttcagcagtcttgacatgggctggttccgccaggctccaggaaaggagcgtgagtttgtagcaggtattagccggagtggtattagccaatactatgcagactccatgaagggccgattcaccatctccagagacaacgccaagaacctggtgtatctgcaaatgaacagcctgaaacctgaggacacggccgtttattactgtgcagcagccctgacctttaggggctccgacctcccacgtgatagtaactactggggccaggggacccaggtcaccgtctcctcagcggccgcatacccgtacgacgttccggactacggttcccaccaccatcaccatcactag

SEQ ID NO: 1208 - DNA, 432 bp, Artificial Sequence
  Artificial polymer
caggtgcagctgcaggagtctgggggaggtgtggtgcagactggggactctctgagactctcctgtgtagcctctggacgcaccttcagcagtcttgacatgggctggttccgccaggctccaggaaaggagcgtgagtttgtagcaggtattagccggagtggtattagccaatactatgcagactccatgaagggccgattcaccatctccagagacaacgccaagaacctggtgtatctgcaaatgaacagcctgaaacctgaggacacggccgtttattactgtgcagcagccctgacctttaggggctccgacctcccacgtgatagtaactactggggccaggggacccaggtcaccgtctcctcagcggccgcatacccgtacgacgttccggactacggttcccaccaccatcaccatcactag

SEQ ID NO: 1209 - DNA, 432 bp, Artificial Sequence
  Artificial polymer
caggtgcagctgcaggagtctgggggaggtgtggtgcaggctggggactctctgagactctcctgtgtagcctctggacgcaccttcagcagccttgacatgggctggttccgccaggctccaggaaaggagcgtgagtttgtagcaggtattagccggagtggtattagccaatactatgcaaactccatgaagggccgattcaccatctccagagacaacgccaagaacctggtgtatctgcaaatgaacagcctgaaacctgaggacacggccgtttattactgtgcagcagccctgacctttaggggctccgacctcccacgtgatagtaactactggggccaggggacccaggtcaccgtctcctcagcggccgcatacccgtacgacgttccggactacggttcccaccaccatcaccatcactag

SEQ ID NO: 1210 - DNA, 432 bp, Artificial Sequence
  Artificial polymer
caggtgcagctgcaggagtctggaggaggtgtggtgcaggctggggaccctctgagactctcctgtgtagcctctggacgcaccttcagcagtcttgacatgggctggttccgccaggctccaggaaaggagcgtgagtttgtagcaggtattagccggagtggtattagccaatactatgcagactccatgaagggccgattcaccatctccagagacaacgccaagaacctggtgtatctgcaaatgaacagcctgaaacctgaggacacggccgtttattactgtgcagcagccctgacctttaggggctccgacctcccacgtgatagtaactactggggccaggggacccaggtcaccgtctcctcagcggccgcatacccgtacgacgttccggactacggttcccaccaccatcaccatcactag

SEQ ID NO: 1211 - DNA, 432 bp, Artificial Sequence
  Artificial polymer
caggtgcagctgcaggagtctgggggaggattggtgcaggctgggggctctctgagactctcctgtgcagcctctggacgcaccttcagcagtcttgacatgggctggttccgccaggctccaggaaaggagcgtgagtttgtagcaggtattagccggagtggtattagccaatactatgcagactccatgaagggccgattcaccatctccagagacaacgccaagaacctggtgtatctgcaaatgaacagcctgaaacctgaggacacggccgtttattactgtgcagcagccctgacctttaggggctccgacctcccacgtgatagtaactactggggccaggggacccaggtcaccgtctcctcagcggccgcatacccgtacgacgttccggactacggttcccaccaccatcaccatcactag

SEQ ID NO: 1212 - DNA, 432 bp, Artificial Sequence
  Artificial polymer
caggtgcagctgcaggagtctgggggaggatgggtgcaacctgggggctctctgagactctcctgtgaagcctctggacgcacctccagcagtcttgacatgggctggttccgccaggctccaggaaaggagcgtgagtttgtagcaggtattagccggacaggtattagcgcatattatgcagactccatgaagggccgattcaccatctccagagacaacgccaagaacctggtgtatctgcaaatgaacagtttgaaatctgaggacacggccgtttattactgtgcagcagccctgacctttaggggctccgacctcccacgtgatagtaactactggggccaggggacccaggtcaccgtctcctcagcggccgcatacccgtacgacgttccggactacggttcccaccaccatcaccatcactag

SEQ ID NO: 1213 - DNA, 432 bp, Artificial Sequence
  Artificial polymer
caggtgcagctgcaggagtctgggggaggatcggtgcaggctgggggctctctgagactctcctgtgtagcctctggacgcaccttcagcagtcttgacatgggctggttccgccaggctccaggaaaggagcgtgagtttgtagcaggtattagccggagtggtattagccaatactatgcagactccatgaagggccgattcaccatctccagagacaacgccaagaacctggtgtatctgcaaatgaacagcctgaaacctgaggacacggccgtttattactgtgcagcagccctgacctttaggggctccgacctcccacgtgatagtaactactggggccaggggacccaggtcaccgtctcctcagcggccgcatacccgtacgacgttccggactacggttcccaccaccatcaccatcactag

SEQ ID NO: 1214 - DNA, 432 bp, Artificial Sequence
  Artificial polymer
caggtgcagctgcaggagtctggaggaggtgtggtgcaggctggggactctctgagactctcctgtgtagcctctggacgcaccttcagcagtcttgacatgggctggttccgccaggctccaggaaaggagcgtgagtttgtagcaggtgttagccggagtggtattagccaatactatgcagactccatgaagggccgattcaccatctccagagacaacgccaagaacctggtgtatctgcaaatgaacagcctgaaacctgaggacacggccgtttattactgtgcagcagccctgacctttaggggctccgacctcccacgtgatagtaactactggggccaggggacccaggtcaccgtctcctcagcggccgcatacccgtacgacgttccggactacggttcccaccaccatcaccatcactag

SEQ ID NO: 1215 - DNA, 432 bp, Artificial Sequence
  Artificial polymer
caggtgcagctgcaggagtctgggggaggcttggtgcagcctggggggtctctgagactctcctgtgcagcctctggacgcaccttcagcagtcttgacatgggctggttccgccaggctccaggaaaggagcgtgagtttgtagcaggtattagccggagtggtattagccaatactatgcagactccatgaagggccgattcaccatctccagagacaacgccaagaacctggtgtatctgcaaataaacagcctgaaacctgaggacacggccgtttattactgtgcagcagccctgacctttaggggctccgacctcccacgtgatagtaactactggggccaggggacccaggtcaccgtctcctcagcggccgcatacccgtacgacgttccggactacggttcccaccaccatcaccatcactag

SEQ ID NO: 1216 - DNA, 432 bp, Artificial Sequence
  Artificial polymer
caggtgcagctgcaggagtctgggggaggtgtggtgcaggctggggactctctgagactctcctgtgtagcctctggacacaccttcagcagtcttgacatgggctggttccgccaggctccaggaaaggagcgtgagtttgtagcaggtattagccggagtggtattagccaatactatgcagactccatgaagggccgattcaccatctccagagacaacgccaagaacctggtgtatctgcaaatgaacagcctgaaacctgaggacacggccgtttattactgtgcagcagccctgacctttaggggctccgacctcccacgtgatagtaactactggggccaggggacccaggtcaccgtctcctcagcggccgcatacccgtacgacgttccggactacggttcccaccaccatcaccatcactag

SEQ ID NO: 1217 - DNA, 432 bp, Artificial Sequence
  Artificial polymer
caggtgcagctgcaggagtctgggggaggtgtggtgcaggctggggactctctgagactctcctgtgtagcctctgaacgcaccttcagcagtcttgacatgggctggttccgccaggctccaggaaaggagcgtgagtttgtagcaggtattagccggagtggtattagccaatactatgcagactccatgaagggccgattcaccatctccagagacaacgccaagaacctggtgtatctgcaaatgaacagcctgaaacctgaggacacggccgtttattactgtgcagcagccctgacctttaggggctccaacctcccacgtgatagtaactactggggccaggggacccaggtcaccgtctcctcagcggccgcatacccgtacgacgttccggactacggttcccaccaccatcaccatcactag

SEQ ID NO: 1218 - DNA, 432 bp, Artificial Sequence
  Artificial polymer
caggtgcagctgcaggagtctgggggaggtgtggtgcaggctggggactctctgagactctcctgtgtagcctctgaacgcaccttcagcagtcttgacatgggctggttccgccaggctccaggaaaggagcgtgagtttgtagcaggtattagccggagtggtattagccaatactatgcagactccatgaagggccgattcaccatctccagagacaacgccaagaacctggtgtatctgcaaatgaacagcctgaaacctgaggacacggccgtttattactgtgcagcagccctgacctttaggggctccgacctcccacgtgatagtaactactggggccaggggacccaggtcaccgtctcctcagcggccgcatacccgtacgacgttccggactacggttcccaccaccatcaccatcactag

SEQ ID NO: 1219 - DNA, 432 bp, Artificial Sequence
  Artificial polymer
caggtgcagctgcaggagtctggaggaggcgtggtgcaggctggggactctctgggactctcctgtgtagcctctggacgcaccttcagcagtcttgacatgggctggttccgccaggctccaggaaaggagcgtgagtttgtagcaggtattagccggagtggtattagccaatactatgcagactccatgaagggccgattcaccatctccagagacaacgccaagaacctggtgtatctgcaaatgaacagcctgaaacctgaggacacggccgtttattactgtgcagcagccctgacctttaggggctccgacctcccacgtgatagtaactactggggccaggggacccaggtcaccgtctcctcagcggccgcatacccgtacgacgttccggactacggttcccaccaccatcaccatcactag

SEQ ID NO: 1220 - DNA, 432 bp, Artificial Sequence
  Artificial polymer
caggtgcagctgcaggagtctgggggaggtgtggtgcaggctggggactctctgagactctcctgtgtagcctctggacgcgccttcagcagtcttgacatgggctggttccgccaggctccaggaaaggagcgtgagtttgtagcaggtattagccggagtggtattagccaatactatgcagactccatgaagggccgattcaccatctccagagacaacgccaagaacctggtgtatctgcaaatgaacagcctgaaacctgaggacacggccgtttattactgtgcagcagccctgacctttaggggctccgacctcccacgtgatagtaactactggggccaggggacccaggtcaccgtctcctcagcggccgcatacccgtacgacgttccggactacggttcccaccaccatcaccatcactag

SEQ ID NO: 1221 - DNA, 432 bp, Artificial Sequence
  Artificial polymer
caggtgcagctgcaggagtctgggggaggtgtggtgcaggctggggactctctgagactctcctgtgtagcctctggacgcaccttcagcagtcttgacatgggctggttccgccaggctccaggaaaggagcgtgagtttgtagcaggtattagccggagtggtattagccaatactatgcagactccatgaagggccgattcaccatctccagagacaacgccaagaacctggtgtatctgcaaatgaacagcctgagacctgaggacacggccgtttattactgtgcagcagccctgacctttaggggctccgacctcccacgtgatagtaactactggggccaggggacccaggtcaccgtctcctcagcggccgcatacccgtacgacgttccggactacggttcccaccaccatcaccatcactag

SEQ ID NO: 1222 - DNA, 432 bp, Artificial Sequence
  Artificial polymer
caggtgcagctgcaggagtctgggggaggatcggtgcaggctggggactctctgagactctcctgtgtagcctctggacgcaccttcagcagtcttgacatgggctggttccgccaggctccaggaaaggagcgtgagtttgtagcaggtattagccggacaggtattagcgcatattatgcagactccatgaagggccgattcaccatctccagagacaacgccaagaacctggtgtatctgcaaatgaacagtttgaaatctgaggacacggccgtttattactgtgcagcagccctgacctttaggggctccgacctcccacgtgatagtaactactggggccaggggacccaggtcaccgtctcctcagcggccgcatacccgtacgacgttccggactacggttcccaccaccatcaccatcactag

SEQ ID NO: 1223 - DNA, 432 bp, Artificial Sequence
  Artificial polymer
caggtgcagctgcaggagtctgggggaggattggtgcagagtggggactctctgagactctcctgtgtagcctctggacgcaccttcagcagtcttgacatgggctggttccgccaggctccaggaaaggagcgtgagtttgtagcaggtattagccggagtggtattagccaatactatgcagactccatgaagggccgattcaccatctccagagacaacgccaagaacctggtgtatctgcaaatgaacagcctgaaacctgaggacacggccgtttattactgtgcagcagccctgacctttaggggctccgacctcccacgtgatagtaactactggggccaggggacccaggtcaccgtctcctcagcggccgcatacccgtacgacgttccggactacggttcccaccaccatcaccatcactag

SEQ ID NO: 1224 - DNA, 432 bp, Artificial Sequence
  Artificial polymer
caggtgcagctgcaggagtctgggggaggattggtgcaggctggggactctctgagactctcctgtgtagcctctggacgcaccttcagcagtcttgacatgggctggttccgccaggctccaggaaaggagcgtgagtttgtagcaggtattagccggagtggtattagccaatactatgcagactccatgaagggccgattcaccatctccagagacaacgccaagaacctggtgtatctgcaaatgaacagcctgaaacctgaggacacggccgtttattactgtgcagcagccctgacctttaggggctccgacctcccacgtgatagtaactactggggccaggggacccaggtcaccgtctcctcagcggccgcatacccgtacgacgttccggactacggttcccaccaccatcaccatcactag

SEQ ID NO: 1225 - DNA, 441 bp, Artificial Sequence
  Artificial polymer
caggtgcagctgcaggagtctgggggaggattggtgcagcctggaggctctctgagactctcctgtgcagcctctgggcttaacttcaggcgctataccatgggctggttccgccaggctccaggaaaggagcgtgagtttgtaggagtcattaactggagtgatgatagcatttactatgcagactccgtgaagggccgattcgccatctccagagacaacaccaagaacacggtgtatctgcaaatggccagcctgaaacctgaggacacggccgtttattactgtgcagcaagcccacagtgggatactcgagtgcgacaaacgatgcgcgggaagtatgactattggggccaggggacccaggtcaccgtctcctcagcggccgcatacccgtacgacgttccggactacggttcccaccaccatcaccatcactag

SEQ ID NO: 1226 - protein, 169 aa, Artificial Sequence
  Synthetic polypeptide
NFMYSKTVKRLSKLREYQQYHPSLTCVMEGKDIEDWSCCPTPWTSFQSSCYFISTGMQSWTKSQKNCSVMGADLVVINTREEQDFIIQNLKRNSSYFLGLSDPGGRRHWQWVDQTPYNENVTFWHSGEPNNLDERCAIINFRSSEEWGWNDIHCHVPQKSICKMKKIYI

SEQ ID NO: 1227 - protein, 10 aa, Artificial Sequence
  Synthetic polypeptide
GSTFRHHAMA

SEQ ID NO: 1228 - protein, 10 aa, Artificial Sequence
  Synthetic polypeptide
GSTFRHHALA

SEQ ID NO: 1229 - protein, 10 aa, Artificial Sequence
  Synthetic polypeptide
GSTFKHHAMA

SEQ ID NO: 1230 - protein, 10 aa, Artificial Sequence
  Synthetic polypeptide
GNNFEHYAVA

SEQ ID NO: 1231 - protein, 10 aa, Artificial Sequence
  Synthetic polypeptide
GDTFSMYAMG

SEQ ID NO: 1232 - protein, 10 aa, Artificial Sequence
  Synthetic polypeptide
GDTFSMYTMG

SEQ ID NO: 1233 - protein, 10 aa, Artificial Sequence
  Synthetic polypeptide
GNTFSMYAMG

SEQ ID NO: 1234 - protein, 10 aa, Artificial Sequence
  Synthetic polypeptide
TDTFSSLAMA

SEQ ID NO: 1235 - protein, 10 aa, Artificial Sequence
  Synthetic polypeptide
GRTFSNYAMG

SEQ ID NO: 1236 - protein, 10 aa, Artificial Sequence
  Synthetic polypeptide
GRTFSDYAMG

SEQ ID NO: 1237 - protein, 10 aa, Artificial Sequence
  Synthetic polypeptide
GRTFSGYAMG

SEQ ID NO: 1238 - protein, 10 aa, Artificial Sequence
  Synthetic polypeptide
GRTFTGYAMG

SEQ ID NO: 1239 - protein, 10 aa, Artificial Sequence
  Synthetic polypeptide
GLTFGRYAMG

SEQ ID NO: 1240 - protein, 10 aa, Artificial Sequence
  Synthetic polypeptide
GFTFDGYAIG

SEQ ID NO: 1241 - protein, 10 aa, Artificial Sequence
  Synthetic polypeptide
GFTFSDYAVG

SEQ ID NO: 1242 - protein, 10 aa, Artificial Sequence
  Synthetic polypeptide
GSTFSDYAVG

SEQ ID NO: 1243 - protein, 10 aa, Artificial Sequence
  Synthetic polypeptide
GRTFINYAMG

SEQ ID NO: 1244 - protein, 10 aa, Artificial Sequence
  Synthetic polypeptide
GRTFSNYAMG

SEQ ID NO: 1245 - protein, 10 aa, Artificial Sequence
  Synthetic polypeptide
GDTFSNYAMG

SEQ ID NO: 1246 - protein, 10 aa, Artificial Sequence
  Synthetic polypeptide
ERTFSNYAMG

SEQ ID NO: 1247 - protein, 10 aa, Artificial Sequence
  Synthetic polypeptide
VFTLNNFIMS

SEQ ID NO: 1248 - protein, 10 aa, Artificial Sequence
  Synthetic polypeptide
GRTFSTYAMG

SEQ ID NO: 1249 - protein, 10 aa, Artificial Sequence
  Synthetic polypeptide
GRNLAYYVMG

SEQ ID NO: 1250 - protein, 10 aa, Artificial Sequence
  Synthetic polypeptide
GFDFSDYVMY

SEQ ID NO: 1251 - protein, 10 aa, Artificial Sequence
  Synthetic polypeptide
GRSISNYNMG

SEQ ID NO: 1252 - protein, 10 aa, Artificial Sequence
  Synthetic polypeptide
GRIFSINAMG

SEQ ID NO: 1253 - protein, 10 aa, Artificial Sequence
  Synthetic polypeptide
GRTFSSYAMG

SEQ ID NO: 1254 - protein, 10 aa, Artificial Sequence
  Synthetic polypeptide
GRTFSSLAMG

SEQ ID NO: 1255 - protein, 10 aa, Artificial Sequence
  Synthetic polypeptide
ERTFTNYAMG

SEQ ID NO: 1256 - protein, 10 aa, Artificial Sequence
  Synthetic polypeptide
GRTFTNYAMG

SEQ ID NO: 1257 - protein, 10 aa, Artificial Sequence
  Synthetic polypeptide
ERTFTNYAMA

SEQ ID NO: 1258 - protein, 10 aa, Artificial Sequence
  Synthetic polypeptide
GRIFSNSAMG

SEQ ID NO: 1259 - protein, 10 aa, Artificial Sequence
  Synthetic polypeptide
GREISSPAMG

SEQ ID NO: 1260 - protein, 10 aa, Artificial Sequence
  Synthetic polypeptide
GRDFANDAVA

SEQ ID NO: 1261 - protein, 10 aa, Artificial Sequence
  Synthetic polypeptide
GRTFSNYAMG

SEQ ID NO: 1262 - protein, 10 aa, Artificial Sequence
  Synthetic polypeptide
GDTFSMYAMG

SEQ ID NO: 1263 - protein, 10 aa, Artificial Sequence
  Synthetic polypeptide
GRDFANDAVA

SEQ ID NO: 1264 - protein, 5 aa, Artificial Sequence
  Synthetic polypeptide
HHAMA

SEQ ID NO: 1265 - protein, 5 aa, Artificial Sequence
  Synthetic polypeptide
HHALA

SEQ ID NO: 1266 - protein, 5 aa, Artificial Sequence
  Synthetic polypeptide
HYAVA

SEQ ID NO: 1267 - protein, 5 aa, Artificial Sequence
  Synthetic polypeptide
MYAMG

SEQ ID NO: 1268 - protein, 5 aa, Artificial Sequence
  Synthetic polypeptide
MYTMG

SEQ ID NO: 1269 - protein, 5 aa, Artificial Sequence
  Synthetic polypeptide
SLAMA

SEQ ID NO: 1270 - protein, 5 aa, Artificial Sequence
  Synthetic polypeptide
NYAMG

SEQ ID NO: 1271 - protein, 5 aa, Artificial Sequence
  Synthetic polypeptide
DYAMG

SEQ ID NO: 1272 - protein, 5 aa, Artificial Sequence
  Synthetic polypeptide
GYAMG

SEQ ID NO: 1273 - protein, 5 aa, Artificial Sequence
  Synthetic polypeptide
RYAMG

SEQ ID NO: 1274 - protein, 5 aa, Artificial Sequence
  Synthetic polypeptide
GYAIG

SEQ ID NO: 1275 - protein, 5 aa, Artificial Sequence
  Synthetic polypeptide
DYAVG

SEQ ID NO: 1276 - protein, 5 aa, Artificial Sequence
  Synthetic polypeptide
NFIMS

SEQ ID NO: 1277 - protein, 5 aa, Artificial Sequence
  Synthetic polypeptide
TYAMG

SEQ ID NO: 1278 - protein, 5 aa, Artificial Sequence
  Synthetic polypeptide
YYVMG

SEQ ID NO: 1279 - protein, 5 aa, Artificial Sequence
  Synthetic polypeptide
DYVMY

SEQ ID NO: 1280 - protein, 5 aa, Artificial Sequence
  Synthetic polypeptide
NYNMG

SEQ ID NO: 1281 - protein, 5 aa, Artificial Sequence
  Synthetic polypeptide
INAMG

SEQ ID NO: 1282 - protein, 5 aa, Artificial Sequence
  Synthetic polypeptide
SYAMG

SEQ ID NO: 1283 - protein, 5 aa, Artificial Sequence
  Synthetic polypeptide
SLAMG

SEQ ID NO: 1284 - protein, 5 aa, Artificial Sequence
  Synthetic polypeptide
NYAMA

SEQ ID NO: 1285 - protein, 5 aa, Artificial Sequence
  Synthetic polypeptide
NSAMG

SEQ ID NO: 1286 - protein, 5 aa, Artificial Sequence
  Synthetic polypeptide
SPAMG

SEQ ID NO: 1287 - protein, 5 aa, Artificial Sequence
  Synthetic polypeptide
NDAVA

SEQ ID NO: 1288 - protein, 5 aa, Artificial Sequence
  Synthetic polypeptide
DYVMY

SEQ ID NO: 1289 - protein, 10 aa, Artificial Sequence
  Synthetic polypeptide
AINDHGTKTR

SEQ ID NO: 1290 - protein, 10 aa, Artificial Sequence
  Synthetic polypeptide
AINDHGDRTK

SEQ ID NO: 1291 - protein, 10 aa, Artificial Sequence
  Synthetic polypeptide
AINNHGTKTR

SEQ ID NO: 1292 - protein, 10 aa, Artificial Sequence
  Synthetic polypeptide
AIRDYGDRTR

SEQ ID NO: 1293 - protein, 10 aa, Artificial Sequence
  Synthetic polypeptide
AISRSGGSTD

SEQ ID NO: 1294 - protein, 10 aa, Artificial Sequence
  Synthetic polypeptide
AISRSGGSTN

SEQ ID NO: 1295 - protein, 10 aa, Artificial Sequence
  Synthetic polypeptide
AISRSGSSTN

SEQ ID NO: 1296 - protein, 10 aa, Artificial Sequence
  Synthetic polypeptide
AISWSGASTV

SEQ ID NO: 1297 - protein, 10 aa, Artificial Sequence
  Synthetic polypeptide
AISWSGDSTV

SEQ ID NO: 1298 - protein, 10 aa, Artificial Sequence
  Synthetic polypeptide
TISVSGSSTD

SEQ ID NO: 1299 - protein, 10 aa, Artificial Sequence
  Synthetic polypeptide
TISKSGSSTD

SEQ ID NO: 1300 - protein, 10 aa, Artificial Sequence
  Synthetic polypeptide
TISTSGSSTY

SEQ ID NO: 1301 - protein, 10 aa, Artificial Sequence
  Synthetic polypeptide
RISRSGNSTG

SEQ ID NO: 1302 - protein, 10 aa, Artificial Sequence
  Synthetic polypeptide
RISRSGDSTG

SEQ ID NO: 1303 - protein, 10 aa, Artificial Sequence
  Synthetic polypeptide
RISRSGDNTG

SEQ ID NO: 1304 - protein, 10 aa, Artificial Sequence
  Synthetic polypeptide
CINKSDGLTY

SEQ ID NO: 1305 - protein, 10 aa, Artificial Sequence
  Synthetic polypeptide
RITRLGNGPY

SEQ ID NO: 1306 - protein, 10 aa, Artificial Sequence
  Synthetic polypeptide
AISTSGSNTY

SEQ ID NO: 1307 - protein, 10 aa, Artificial Sequence
  Synthetic polypeptide
AISTSGGSTA

SEQ ID NO: 1308 - protein, 10 aa, Artificial Sequence
  Synthetic polypeptide
AISRSAGSTY

SEQ ID NO: 1309 - protein, 10 aa, Artificial Sequence
  Synthetic polypeptide
AISTSGGTTD

SEQ ID NO: 1310 - protein, 9 aa, Artificial Sequence
  Synthetic polypeptide
DINMVGITD

SEQ ID NO: 1311 - protein, 10 aa, Artificial Sequence
  Synthetic polypeptide
AIATNGGTTY

SEQ ID NO: 1312 - protein, 10 aa, Artificial Sequence
  Synthetic polypeptide
TLTRGGDDTY

SEQ ID NO: 1313 - protein, 10 aa, Artificial Sequence
  Synthetic polypeptide
SINASGVRTY

SEQ ID NO: 1314 - protein, 10 aa, Artificial Sequence
  Synthetic polypeptide
SIRWDGDSTY

SEQ ID NO: 1315 - protein, 9 aa, Artificial Sequence
  Synthetic polypeptide
VISRSGISN

SEQ ID NO: 1316 - protein, 9 aa, Artificial Sequence
  Synthetic polypeptide
VISWRNNTY

SEQ ID NO: 1317 - protein, 10 aa, Artificial Sequence
  Synthetic polypeptide
AINWSGDSTY

SEQ ID NO: 1318 - protein, 10 aa, Artificial Sequence
  Synthetic polypeptide
AISRSGSSTS

SEQ ID NO: 1319 - protein, 10 aa, Artificial Sequence
  Synthetic polypeptide
TISRSGSMPY

SEQ ID NO: 1320 - protein, 10 aa, Artificial Sequence
  Synthetic polypeptide
AVEWSSGSTF

SEQ ID NO: 1321 - protein, 10 aa, Artificial Sequence
  Synthetic polypeptide
TISRSGSSTF

SEQ ID NO: 1322 - protein, 10 aa, Artificial Sequence
  Synthetic polypeptide
AISENSSILY

SEQ ID NO: 1323 - protein, 10 aa, Artificial Sequence
  Synthetic polypeptide
YISRTGGSTK

SEQ ID NO: 1324 - protein, 10 aa, Artificial Sequence
  Synthetic polypeptide
TINWSSGATL

SEQ ID NO: 1325 - protein, 9 aa, Artificial Sequence
  Synthetic polypeptide
GIGSNNGTL

SEQ ID NO: 1326 - protein, 17 aa, Artificial Sequence
  Synthetic polypeptide
AINDHGTKTRYSDSVRG

SEQ ID NO: 1327 - protein, 17 aa, Artificial Sequence
  Synthetic polypeptide
AINDHGDRTKYLDSVRG

SEQ ID NO: 1328 - protein, 17 aa, Artificial Sequence
  Synthetic polypeptide
AINNHGTKTRYSDSVRG

SEQ ID NO: 1329 - protein, 17 aa, Artificial Sequence
  Synthetic polypeptide
AINDHGDRTKYTDSVRG

SEQ ID NO: 1330 - protein, 17 aa, Artificial Sequence
  Synthetic polypeptide
AINDHGDRTKYSDSVRG

SEQ ID NO: 1331 - protein, 17 aa, Artificial Sequence
  Synthetic polypeptide
AIRDYGDRTRYDDSVKG

SEQ ID NO: 1332 - protein, 17 aa, Artificial Sequence
  Synthetic polypeptide
AIRDYGDRTRYADSVKG

SEQ ID NO: 1333 - protein, 17 aa, Artificial Sequence
  Synthetic polypeptide
AISRSGGSTDYRDSVKG

SEQ ID NO: 1334 - protein, 17 aa, Artificial Sequence
  Synthetic polypeptide
AISRSGGSTNYRDSVKG

SEQ ID NO: 1335 - protein, 17 aa, Artificial Sequence
  Synthetic polypeptide
AISRSGSSTNYRDSVKG

SEQ ID NO: 1336 - protein, 17 aa, Artificial Sequence
  Synthetic polypeptide
AISWSGASTVYGDSVKG

SEQ ID NO: 1337 - protein, 17 aa, Artificial Sequence
  Synthetic polypeptide
AISWSGDSTVYGDSVKG

SEQ ID NO: 1338 - protein, 17 aa, Artificial Sequence
  Synthetic polypeptide
TISVSGSSTDYADSVKG

SEQ ID NO: 1339 - protein, 17 aa, Artificial Sequence
  Synthetic polypeptide
TISKSGSSTDYADSAKG

SEQ ID NO: 1340 - protein, 17 aa, Artificial Sequence
  Synthetic polypeptide
TISTSGSSTYYADSVKG

SEQ ID NO: 1341 - protein, 17 aa, Artificial Sequence
  Synthetic polypeptide
RISRSGNSTGYADSVKG

SEQ ID NO: 1342 - protein, 17 aa, Artificial Sequence
  Synthetic polypeptide
RISRSGDSTGYADSVKG

SEQ ID NO: 1343 - protein, 17 aa, Artificial Sequence
  Synthetic polypeptide
RISRSGDNTGYADSVKG

SEQ ID NO: 1344 - protein, 17 aa, Artificial Sequence
  Synthetic polypeptide
CINKSDGLTYYEDSVKG

SEQ ID NO: 1345 - protein, 17 aa, Artificial Sequence
  Synthetic polypeptide
RITRLGNGPYYSASVKG

SEQ ID NO: 1346 - protein, 17 aa, Artificial Sequence
  Synthetic polypeptide
AISTSGSNTYLADSLKA

SEQ ID NO: 1347 - protein, 17 aa, Artificial Sequence
  Synthetic polypeptide
AISTSGGSTAYADSVKG

SEQ ID NO: 1348 - protein, 17 aa, Artificial Sequence
  Synthetic polypeptide
AISRSAGSTYHVDSVKG

SEQ ID NO: 1349 - protein, 17 aa, Artificial Sequence
  Synthetic polypeptide
AISTSGGTTDYVDSVKG

SEQ ID NO: 1350 - protein, 16 aa, Artificial Sequence
  Synthetic polypeptide
DINMVGITDYSDPVKG

SEQ ID NO: 1351 - protein, 17 aa, Artificial Sequence
  Synthetic polypeptide
AIATNGGTTYYVDSVKG

SEQ ID NO: 1352 - protein, 17 aa, Artificial Sequence
  Synthetic polypeptide
TLTRGGDDTYCADSVKG

SEQ ID NO: 1353 - protein, 17 aa, Artificial Sequence
  Synthetic polypeptide
SINASGVRTYYVDALKG

SEQ ID NO: 1354 - protein, 17 aa, Artificial Sequence
  Synthetic polypeptide
SIRWDGDSTYYADSVKG

SEQ ID NO: 1355 - protein, 16 aa, Artificial Sequence
  Synthetic polypeptide
VISRSGISNYVDSVKG

SEQ ID NO: 1356 - protein, 16 aa, Artificial Sequence
  Synthetic polypeptide
VISWRNNTYYADSVKG

SEQ ID NO: 1357 - protein, 17 aa, Artificial Sequence
  Synthetic polypeptide
AINWSGDSTYYSDSMKG

SEQ ID NO: 1358 - protein, 17 aa, Artificial Sequence
  Synthetic polypeptide
AISRSGSSTSYADSVKG

SEQ ID NO: 1359 - protein, 17 aa, Artificial Sequence
  Synthetic polypeptide
TISRSGSMPYYADSVKG

SEQ ID NO: 1360 - protein, 17 aa, Artificial Sequence
  Synthetic polypeptide
AVEWSSGSTFYTDSVKG

SEQ ID NO: 1361 - protein, 17 aa, Artificial Sequence
  Synthetic polypeptide
TISRSGSSTFYAESVKG

SEQ ID NO: 1362 - protein, 17 aa, Artificial Sequence
  Synthetic polypeptide
AISENSSILYYTASVKG

SEQ ID NO: 1363 - protein, 17 aa, Artificial Sequence
  Synthetic polypeptide
YISRTGGSTKYENSVKG

SEQ ID NO: 1364 - protein, 17 aa, Artificial Sequence
  Synthetic polypeptide
TINWSSGATLTADSVKG

SEQ ID NO: 1365 - protein, 16 aa, Artificial Sequence
  Synthetic polypeptide
GIGSNNGTLTADSVKG

SEQ ID NO: 1366 - protein, 16 aa, Artificial Sequence
  Synthetic polypeptide
GPLVDYLETVPVVYTY

SEQ ID NO: 1367 - protein, 16 aa, Artificial Sequence
  Synthetic polypeptide
GPLVDYLETTPLVYTY

SEQ ID NO: 1368 - protein, 16 aa, Artificial Sequence
  Synthetic polypeptide
GPLNDYLEVTPLVYTY

SEQ ID NO: 1369 - protein, 18 aa, Artificial Sequence
  Synthetic polypeptide
RLTFSTTTAYTGELQYPY

SEQ ID NO: 1370 - protein, 18 aa, Artificial Sequence
  Synthetic polypeptide
RLTFSTTTTYTGELQYPY

SEQ ID NO: 1371 - protein, 18 aa, Artificial Sequence
  Synthetic polypeptide
RLTFSTTDAYTGKLQYPY

SEQ ID NO: 1372 - protein, 16 aa, Artificial Sequence
  Synthetic polypeptide
DLDGRTWHGDDLEYDY

SEQ ID NO: 1373 - protein, 18 aa, Artificial Sequence
  Synthetic polypeptide
RLSFDNTALYTSANRYSY

SEQ ID NO: 1374 - protein, 18 aa, Artificial Sequence
  Synthetic polypeptide
RLSFDNTAFYTSAIRYSD

SEQ ID NO: 1375 - protein, 18 aa, Artificial Sequence
  Synthetic polypeptide
RLSFDNTAFYTSAIRYSY

SEQ ID NO: 1376 - protein, 15 aa, Artificial Sequence
  Synthetic polypeptide
TTSWLPGHNANVYDY

SEQ ID NO: 1377 - protein, 15 aa, Artificial Sequence
  Synthetic polypeptide
GTSWVPGHNANAYDY

SEQ ID NO: 1378 - protein, 13 aa, Artificial Sequence
  Synthetic polypeptide
AWECDYAPADFGS

SEQ ID NO: 1379 - protein, 19 aa, Artificial Sequence
  Synthetic polypeptide
GRTLASTHDTKTSPQTYDY

SEQ ID NO: 1380 - protein, 18 aa, Artificial Sequence
  Synthetic polypeptide
RLSFDDSAYYTSTLRYAY

SEQ ID NO: 1381 - protein, 18 aa, Artificial Sequence
  Synthetic polypeptide
RLSFSGSSYYQGPLQYPY

SEQ ID NO: 1382 - protein, 18 aa, Artificial Sequence
  Synthetic polypeptide
RLTFNLIDYYTAETRYTY

SEQ ID NO: 1383 - protein, 18 aa, Artificial Sequence
  Synthetic polypeptide
RLDFSSTDLYTTAPRYPY

SEQ ID NO: 1384 - protein, 18 aa, Artificial Sequence
  Synthetic polypeptide
GRPIGLYYPSPRIRDYND

SEQ ID NO: 1385 - protein, 17 aa, Artificial Sequence
  Synthetic polypeptide
RLSFGSGYYTNKLNYAY

SEQ ID NO: 1386 - protein, 17 aa, Artificial Sequence
  Synthetic polypeptide
RLAVLSSNTYCSGLWDY

SEQ ID NO: 1387 - protein, 12 aa, Artificial Sequence
  Synthetic polypeptide
VGQAPMYFGVDF

SEQ ID NO: 1388 - protein, 16 aa, Artificial Sequence
  Synthetic polypeptide
TVSSFDESKNPRWYPY

SEQ ID NO: 1389 - protein, 12 aa, Artificial Sequence
  Synthetic polypeptide
DVLLTFNKREDS

SEQ ID NO: 1390 - protein, 15 aa, Artificial Sequence
  Synthetic polypeptide
AGLGAVVAGMSDYDY

SEQ ID NO: 1391 - protein, 15 aa, Artificial Sequence
  Synthetic polypeptide
DASGYGSAWPDRYDY

SEQ ID NO: 1392 - protein, 14 aa, Artificial Sequence
  Synthetic polypeptide
APLVLKTTPGAYNY

SEQ ID NO: 1393 - protein, 14 aa, Artificial Sequence
  Synthetic polypeptide
NVLVTTTRLDQYDS

SEQ ID NO: 1394 - protein, 14 aa, Artificial Sequence
  Synthetic polypeptide
DHTGKLVFSKTSDY

SEQ ID NO: 1395 - protein, 14 aa, Artificial Sequence
  Synthetic polypeptide
RPLVPSEDPDNYNY

SEQ ID NO: 1396 - protein, 14 aa, Artificial Sequence
  Synthetic polypeptide
YGSTTIRTTTRPTK

SEQ ID NO: 1397 - protein, 14 aa, Artificial Sequence
  Synthetic polypeptide
HYNGVYQDSQSYDY

SEQ ID NO: 1398 - protein, 14 aa, Artificial Sequence
  Synthetic polypeptide
GATGVFRIARAYSY

SEQ ID NO: 1399 - protein, 13 aa, Artificial Sequence
  Synthetic polypeptide
GPTFFRIARAYPY

SEQ ID NO: 1400 - protein, 125 aa, Artificial Sequence
  Synthetic polypeptide
QVQLQESGGGLVRPGGSLRLSCVGSGSTFRHHAMAWFRQTTGKEREFVSAINDHGTKTRYSDSVRGRFTISRDNDENMVYLQMDNLRPEDTAVYSCAAGPLVDYLETVPVVYTYWGQGTQVTVSS

SEQ ID NO: 1401 - protein, 125 aa, Artificial Sequence
  Synthetic polypeptide
QVQLQESGGGLVQPGGSLRLSCAASGSTFRHHAMAWFRQTPGKEREFVSAINDHGDRTKYLDSVRGRFTISRDNTDNMVYLLMSDLRPEDTAVYSCAAGPLVDYLETTPLVYTYWGQGTQVTVSS

SEQ ID NO: 1402 - protein, 125 aa, Artificial Sequence
  Synthetic polypeptide
QVQLQESGGGLVQPGGSLRLSCVGSGSTFRHHAMAWFRQTAGKEREFVSAINNHGTKTRYSDSVRGRFTISRDNDENMVYLQMDNLRPEDTAVYSCAAGPLVDYLETVPVVYTYWGQGTQVTVSS

SEQ ID NO: 1403 - protein, 125 aa, Artificial Sequence
  Synthetic polypeptide
  X (40)..(40): Any naturally occurring amino acid
QVQLQESGGGLVQPGESLKLSCAGSGSTFRHHAMAWFRQXPGKEREFVSAINDHGDRTKYLDSVRGRFTISRDNTNNMVYLQMSDLRPEDTANYSCAAGPLVDYLETTPLVYTYWGQGTQVTVSS

SEQ ID NO: 1404 - protein, 125 aa, Artificial Sequence
  Synthetic polypeptide
QVQLQESGGGLVQPGGSLRISCAGSGSTFRHHAMAWFRQTAGKEREFVSAINDHGTKTRYSDSVRGRFTISRDNDENMVYLQMDNLRSEDTANYTCAAGPLVDYLETVPVVYTYWGQGTQVTVSS

SEQ ID NO: 1405 - protein, 125 aa, Artificial Sequence
  Synthetic polypeptide
QVQLQESGGGLVQPGGSLKLSCAGSGSTFRHHALAWFRQTAEKEREFVSAINDHGTKTRYSDSVRGRFTISRDNDGNMVYLQMDNLRPEDTAVYSCAAGPLVDYLETVPVVYTYWGQGTQVTVSS

SEQ ID NO: 1406 - protein, 125 aa, Artificial Sequence
  Synthetic polypeptide
QVQLQESGGGLVQAGGSLRLSCAASGSTFRHHAMAWFRQTPGKEREFVSAINDHGDRTKYLDSVRGRFTISRDNTDNMVYLQMSDLRTEDTAVYTCAAGPLVDYLETTPLVYTYWGQGTQVTVSS

SEQ ID NO: 1407 - protein, 125 aa, Artificial Sequence
  Synthetic polypeptide
QVQLQESGGGLVQPGGSLKLSCAASGSTFRHHAMAWFRQTPGKEREFVSAINDHGDRTKYLDSVRGRFTISRDNTDNMVYLQMSDLRPEDTAVYSCAAGPLVDYLETTPLVYTYWGQGTQVTVSS

SEQ ID NO: 1408 - protein, 125 aa, Artificial Sequence
  Synthetic polypeptide
QVQLQESGGGVVQPGGSLKLSCAASGSTFRHHAMAWFRQTPGKEREFVSAINDHGDRTKYLDSVRGRFTISRDDTDNMVYLQMSDLRTEDTAVYTCAAGPLVDYLETTPLVYTYWGQGTQVTVSS

SEQ ID NO: 1409 - protein, 125 aa, Artificial Sequence
  Synthetic polypeptide
QVQLQESGGGLVQPGGSLRLSCAGSGSTFRHHAMAWFRQTPGKEREFVSAINDHGDRTKYTDSVRGRFTISRDNTDNMVYLQMSDLRPEDTAVYSCAAGPLVDYLETTPLVYTYWGQGTQVTVSS

SEQ ID NO: 1410 - protein, 125 aa, Artificial Sequence
  Synthetic polypeptide
QVQLQESGGGLVQPGGSLKLSCTGSGSTFRHHAMAWFRQTPGKEREFVAAINDHGDRTKYLDSVRGRFTISRDNTDNMVYLQMSDLRPEDTANYSCAAGPLVDYLETTPLVYTYWGQGTQVTVSS

SEQ ID NO: 1411 - protein, 125 aa, Artificial Sequence
  Synthetic polypeptide
QVQLQESGGGLVQAGGSLRLSCAASGSTFRHHAMAWFRQTPGKGREFVSAINDHGDRTKYLDSVRGRFTISRDNTDNMVYLQMSDLRPEDTAVYSCAAGPLVDYLETTPLVYTYWGQGTQVTVSS

SEQ ID NO: 1412 - protein, 125 aa, Artificial Sequence
  Synthetic polypeptide
QVQLQESGGGLVQPGGSLKLSCAGSGSTFKHHAMAWFRHTPGKEREFVSAINDHGDRTKYSDSVRGRFTIARDNTDNMVYLQMDDLLPEDTANYTCAAGPLVDYLETTPLVYTYWGQGTQVTVSS

SEQ ID NO: 1413 - protein, 126 aa, Artificial Sequence
  Synthetic polypeptide
QVQLQESGGGLAQAGASLRLSCAGSGNNFEHYAVAWFRQDAPGKERDFVAAIRDYGDRTRYDDSVKGRFTISRDNAKSMVYLEMNNLKPKDAAVYYCAAGPLNDYLEVTPLVYTYWGQGTQVTVSS

SEQ ID NO: 1414 - protein, 126 aa, Artificial Sequence
  Synthetic polypeptide
QVQLQESGGGLAQAGASLRLSCAGSGNNFEHYAVAWFRQEAPGKERDFVAAIRDYGDRTRYADSVKGRFTISRDNAKSMVYLEMNNLKPEDTAVYYCTAGPLNDYLEVTPLVYTYWGQGTQVTVSS

SEQ ID NO: 1415 - protein, 127 aa, Artificial Sequence
  Synthetic polypeptide
QVQLQESGGGLVQAGDSLRLSCAASGDTFSMYAMGWFRQAPGKEREFVAAISRSGGSTDYRDSVKGRFTISRDNDLNAGYLQMNSLKPEDTAVYYCALRLTFSTTTAYTGELQYPYWGQGTQVTVSS

SEQ ID NO: 1416 - protein, 127 aa, Artificial Sequence
  Synthetic polypeptide
QVQLQESGGGLVQAGDSLRLSCAASGDTFSMYTMGWFRQAPGKEREFVAAISRSGGSTNYRDSVKGRFTISRDNDLNAGYLQMNSLKPEDTAVYYCALRLTFSTTTAYTGELQYPYWGQGTQVTVSS

SEQ ID NO: 1417 - protein, 127 aa, Artificial Sequence
  Synthetic polypeptide
QVQLQESGGGLVQAGDSLRLSCAASGDTFSMYAMGWFRQAPGKEREFVAAISRSGSSTNYRDSVKGRFTISRDNDLNAGYLQMNSLKPEDTAVYYCALRLTFSTTTTYTGELQYPYWGQGTQVTVSS

SEQ ID NO: 1418 - protein, 127 aa, Artificial Sequence
  Synthetic polypeptide
QVQLQESGGGLVQAGDSLRLSCAASGNTFSMYAMGWFRQAPGKEREFVAAISRSGGSTNYRDSVKGRFTISRDNDLNAGYLQMNNLKPEDTAVYYCALRLTFSTTDAYTGKLQYPYWGQGTQVTVSS

SEQ ID NO: 1419 - protein, 125 aa, Artificial Sequence
  Synthetic polypeptide
QVQLQESGGGTVQPGESLRLSCEVSTDTFSSLAMAWFRQATGKDREFVAAISWSGASTVYGDSVKGRFTMTRDHPKKMVYLQMDNLKPEDTAVYYCAGDLDGRTWHGDDLEYDYWGQGTQVTVSS

SEQ ID NO: 1420 - protein, 125 aa, Artificial Sequence
  Synthetic polypeptide
QVQLQESGGGLVQPGGSLRLSCEVSTDTFSSLAMAWFRQATGKEREFVAAISWSGASTVYGDSVKGRFTMTRDHPKKMVYLQMDNLKPEDTAVYYCAGDLDGRTWHGDDLEYDYWGQGTQVTVSS

SEQ ID NO: 1421 - protein, 125 aa, Artificial Sequence
  Synthetic polypeptide
QVQLQESGGGTVQPGESLRLSCEVSTDTFSSLAMAWFRQATAKDREFVAAISWSGDSTVYGDSVKGRFTMTRDHPKKMVYLQMDNLKPEDTAVYYCAGDLDGRTWHGDDLEYDYWGQGTQVTVSS

SEQ ID NO: 1422 - protein, 127 aa, Artificial Sequence
  Synthetic polypeptide
  X (36)..(36): Any naturally occurring amino acid
QVQLQESGGGSVQAGGSLRLSCAASGRTFSNYAMGXFRQTPGKEREFVATISVSGSSTDYADSVKGRFTISRDNAKKTVYLQINSLKTEDTAVYYCAARLSFDNTALYTSANRYSYWGQGTQVTVSS

SEQ ID NO: 1423 - protein, 127 aa, Artificial Sequence
  Synthetic polypeptide
QVQLQESGGGSVQAGGSLRLSCAASGRTFSDYAMGWFRQAPGKEREFVATISKSGSSTDYADSAKGRFTISRDNAKKTVYLQINSLKTEDTAVYYCAARLSFDNTAFYTSAIRYSDWGQGTQVTVSS

SEQ ID NO: 1424 - protein, 127 aa, Artificial Sequence
  Synthetic polypeptide
QVQLQESGGGSVQAGDSLRLSCAASGRTFSGYAMGWFRQAPGKEREFVATISTSGSSTYYADSVKGRFTISRDNAKKSVYLQINSLKTEDAAVYYCAARLSFDNTAFYTSAIRYSYWGQGTQVTVSS

SEQ ID NO: 1425 - protein, 124 aa, Artificial Sequence
  Synthetic polypeptide
QVQLQESGGGLVQAGGSLRLSCAASGRTFTGYAMGWFRQVPGLEREFVARISRSGNSTGYADSVKGRFTVSRDNAKSTMYLQMNSLKTEDTAVYYCAATTSWLPGHNANVYDYWGQGTQVTVSS

SEQ ID NO: 1426 - protein, 124 aa, Artificial Sequence
  Synthetic polypeptide
QVQLQESGGGSVQAGGSLRLSCAASGRTFSDYAMGWFRQVPGLEREFVARISRSGDSTGYADSVKGRFTVSRDNAKNTVYLQMNSLKTEDTAVYYCAATTSWLPGHNANVYDYWGQGTQVTVSS

SEQ ID NO: 1427 - protein, 124 aa, Artificial Sequence
  Synthetic polypeptide
QVQLQESGGGLVQAGGSLRLSCAASGLTFGRYAMGWFRQVPGLEREFIARISRSGDNTGYADSVKGRFTVSRDSAKSTVYLQMNSLKTEDTAVYYCAAGTSWVPGHNANAYDYWGQGTQVTVSS

SEQ ID NO: 1428 - protein, 122 aa, Artificial Sequence
  Synthetic polypeptide
QVQLQESGGGLVQAGDSLRLSCAPSGFTFDGYAIGWFRQAPGKEREKVACINKSDGLTYYEDSVKGRFTISSDTAKNTIHLQMNSLKPDDTAVYYCAAAWECDYAPADFGSWGQGTQVTVSS

SEQ ID NO: 1429 - protein, 122 aa, Artificial Sequence
  Synthetic polypeptide
QVQLQESGGGLVQAGGSLRLSCAPSGFTFDGYAIGWFRQAPGKEREKVACINKSDGLTYYEDSVKGRFTISSDTAKNTIHLQMNSLKPDDTAVYYCAAAWECDYAPADFGSWGQGTQVTVSS

SEQ ID NO: 1430 - protein, 128 aa, Artificial Sequence
  Synthetic polypeptide
QVQLQESGGGWVQPGDSLRLSCAASGFTFSDYAVGWFRQAPGKEREFVARITRLGNGPYYSASVKGRFTISRDNARDMAYLKMDALTPEDTATYYCAAGRTLASTHDTKTSPQTYDYWGLGTQVTVSS

SEQ ID NO: 1431 - protein, 128 aa, Artificial Sequence
  Synthetic polypeptide
QVQLQESGGGWVQPGDSLRLSCAASGSTFSDYAVGWFRQAPGKEREFVARITRLGNGPYYSASVKGRFTISRDNARDMAYLKMDALTPEDTATYYCAAGRTLASTHDTKTSPQTYDYWGQGTQVTVSS

SEQ ID NO: 1432 - protein, 127 aa, Artificial Sequence
  Synthetic polypeptide
QVQLQESGGGLVQAGGSRRLSCAASGRTFINYAMGWFRQAPGKEREFVAAISTSGSNTYLADSLKARFTISRDNAKNTVYLQIRSLNPEDTAVYYCAARLSFDDSAYYTSTLRYAYWGQGTQVTVSS

SEQ ID NO: 1433 - protein, 127 aa, Artificial Sequence
  Synthetic polypeptide
QVQLQESGGGLVQPGDSLTLSCADSGRTFSNYAMGWFHQAPGKEREFVAAISTSGGSTAYADSVKGRFTISRDNAKNTVYLQMNNLKPEDTAVYYCAARLSFSGSSYYQGPLQYPYWGQGTQVTVSS

SEQ ID NO: 1434 - protein, 127 aa, Artificial Sequence
  Synthetic polypeptide
QVQLQESGGGLVQPGGSLRLSCAASGDTFSNYAMGWFRQAPGKAREFVAAISRSAGSTYHVDSVKGRFTISRDNAMNTVYLQMNSLQPEDTAHYYCAARLTFNLIDYYTAETRYTYWGQGTQVTVSS

SEQ ID NO: 1435 - protein, 127 aa, Artificial Sequence
  Synthetic polypeptide
QVQLQESGGGLVQAGDSLRLSCTASERTFSNYAMGWFRLAPGKERKFVAAISTSGGTTDYVDSVKGRFTISRDNAKNTVYLQMNSLKPEDTAVYYCAARLDFSSTDLYTTAPRYPYWGQGTQVTVSS

SEQ ID NO: 1436 - protein, 126 aa, Artificial Sequence
  Synthetic polypeptide
QVQLQESGGGLVQPGGSVRLSCAASVFTLNNFIMSWVRQAPGKGLERVSDINMVGITDYSDPVKGRFTISRDNKQNTVYLQGNTLKPEDTAVYFCAAGRPIGLYYPSPRIRDYNDWGQGTQVTVSS

SEQ ID NO: 1437 - protein, 126 aa, Artificial Sequence
  Synthetic polypeptide
QVQLQESGGGLVQAGDSLKLSCAASGRTFSTYAMGWFRQAPGKERDVVAAIATNGGTTYYVDSVKGRFTISRDNAQNRVYLQMNSLKPEDTAIYYCAARLSFGSGYYTNKLNYAYWGQGTQVTVSS

SEQ ID NO: 1438 - protein, 126 aa, Artificial Sequence
  Synthetic polypeptide
QVQLQESGGGLVQAGNSLKLSCAASGRNLAYYVMGWFRQAPGREREPVATLTRGGDDTYCADSVKGRFTISSDNAKNTVYLQMNNLKPEDTAIYTCAARLAVLSSNTYCSGLWDYWGQGTQVTVSS

SEQ ID NO: 1439 - protein, 121 aa, Artificial Sequence
  Synthetic polypeptide
QVQLQESGGGLVQPGGSLTLSCGASGFDFSDYVMYWLRQAPGKGLQWVSSINASGVRTYYVDALKGRFTISRDNAKNTLYLQIDDLKPEDTGLYYCARVGQAPMYFGVDFWGNGTQVTVSS

SEQ ID NO: 1440 - protein, 125 aa, Artificial Sequence
  Synthetic polypeptide
QVQLQESGGGLVQTGGSLRVSCAASGRSISNYNMGWFRQPPGKEREIVGSIRWDGDSTYYADSVKGRFTISRDNTKNTVYLQMNSLKSEDTADYYCAATVSSFDESKNPRWYPYWGQGTQVTVSS

SEQ ID NO: 1441 - protein, 120 aa, Artificial Sequence
  Synthetic polypeptide
QVQLQESGGGLVQPGGSLRLSCAASGRIFSINAMGWYRQAPGKQRELVAVISRSGISNYVDSVKGRFTISRDNAKNTVYLQMNSLNPEDTADYYCNADVLLTFNKREDSWGQGTQVTVSS

SEQ ID NO: 1442 - protein, 123 aa, Artificial Sequence
  Synthetic polypeptide
QVQLQESGGGLVQAGGSLKLSCAASGRTFSSYAMGWFRQAPGKERDFVAVISWRNNTYYADSVKGRFTISRDNAKNTVHLQMNSLKSEDTAVYYCAAAGLGAVVAGMSDYDYWGQGTQVTVSS

SEQ ID NO: 1443 - protein, 124 aa, Artificial Sequence
  Synthetic polypeptide
QVQLQESGGGSVQAGDSLTLSCIASGRTFSSLAMGWFRQAPGKEREFVAAINWSGDSTYYSDSMKGRLTMSRDNAKNTVFLQMNSLEPEDTAVYVCAADASGYGSAWPDRYDYWGQGTQVTVSS

SEQ ID NO: 1444 - protein, 123 aa, Artificial Sequence
  Synthetic polypeptide
QVQLQESGGGLVQAGGSLRLSCAASERTFTNYAMGWFRQGPGKDRAFVAAISRSGSSTSYADSVKGRFTISRDNAENILYLQMNSLKPEDTAVYYCAAAPLVLKTTPGAYNYWGQGTQVTVSS

SEQ ID NO: 1445 - protein, 123 aa, Artificial Sequence
  Synthetic polypeptide
QVQLQESGGGLVQAGGSLRLSCAASGRTFTNYAMGWFRQAPGKEREFVATISRSGSMPYYADSVKGRFTISRDNAKNMVYLQMNSLKPEDTAVYYCAANVLVTTTRLDQYDSWGQGTQVTVSS

SEQ ID NO: 1446 - protein, 123 aa, Artificial Sequence
  Synthetic polypeptide
QVQLQESGGGLVQAGGSLRLSCAVSGRTFSSYAMGWFRQARGKEREFVAAVEWSSGSTFYTDSVKGRFAISRDIAKNTVYLQMNSLKPEDTAVYYCAGDHTGKLVFSKTSDYWGQGTQVTVSS

SEQ ID NO: 1447 - protein, 123 aa, Artificial Sequence
  Synthetic polypeptide
QVQLQESGGGLVQPGDSLRLSCTASERTFTNYAMAWFRQAPGKERDVLATISRSGSSTFYAESVKGRFTISRDNTKNTVYLQMNSLEPEDTAVYYCAARPLVPSEDPDNYNYWGQGTQVTVSS

SEQ ID NO: 1448 - protein, 123 aa, Artificial Sequence
  Synthetic polypeptide
QVQLQESGGGLVQAGGSLRLSCAASGRIFSNSAMGWFRQVLGKEREFVAAISENSSILYYTASVKGRFTISRDNDKNTVYLQMTSLKAEDTAVYYCAGYGSTTIRTTTRPTKWGQGTQVTVSS

SEQ ID NO: 1449 - protein, 123 aa, Artificial Sequence
  Synthetic polypeptide
  X (115)..(115): Any naturally occurring amino acid.
QVQLQESGGGLVQAGDSLRLSCVASGRTLSNYGMGWFRQAPGKGREFVAYISRTGGSTKYENSVKGRFIISRDTAKNTIYLQMNSLQGEDTAVYYCAFHYNGVYQDSQSYDYWGXGTQVTVSS

SEQ ID NO: 1450 - protein, 123 aa, Artificial Sequence
  Synthetic polypeptide
QVQLQESGGGSVQAGDSLRLSCVAPGREISSPAMGWFRQAPGKEREFVATINWSSGATLTADSVKGRFTIFKDVEKNTVYLQMNSLRPEDTAVYSCAAGATGVFRIARAYSYWGQGTQVTVSS

SEQ ID NO: 1451 - protein, 121 aa, Artificial Sequence
  Synthetic polypeptide
  X (39)..(39): Any naturally occurring amino acid.
QVQLQESGGGLMQAGDSLRLSCTVSGRDFANDAVAWFRXPPGKEREFVVGIGSNNGTLTADSVKGRSTIWRDNIKNTVYLQMSRLTPDDTAVYYCASGPTFFRIARAYPYWGQGTQVTVSS

SEQ ID NO: 1452 - protein, 125 aa, Artificial Sequence
  Synthetic polypeptide
QVQLQESGGGLVQPGESLKLSCAGSGSTFRHHAMAWFRQTPGKEREFVSAINDHGDRTKYLDSVRGRFTISRDNTNNMVYLQMSDLRPEDTANYSCAAGPLVDYLETTPLVYTYWGQGTQVTVSS

SEQ ID NO: 1453 - protein, 127 aa, Artificial Sequence
  Synthetic polypeptide
QVQLQESGGGSVQAGGSLRLSCAASGRTFSNYAMGWFRQTPGKEREFVATISVSGSSTDYADSVKGRFTISRDNAKKTVYLQINSLKTEDTAVYYCAARLSFDNTALYTSANRYSYWGQGTQVTVSS

SEQ ID NO: 1454 - protein, 123 aa, Artificial Sequence
  Synthetic polypeptide
QVQLQESGGGLVQAGDSLRLSCVASGRTLSNYGMGWFRQAPGKGREFVAYISRTGGSTKYENSVKGRFIISRDTAKNTIYLQMNSLQGEDTAVYYCAFHYNGVYQDSQSYDYWGQGTQVTVSS

SEQ ID NO: 1455 - protein, 121 aa, Artificial Sequence
  Synthetic polypeptide
QVQLQESGGGLMQAGDSLRLSCTVSGRDFANDAVAWFRQPPGKEREFVVGIGSNNGTLTADSVKGRSTIWRDNIKNTVYLQMSRLTPDDTAVYYCASGPTFFRIARAYPYWGQGTQVTVSS

SEQ ID NO: 1456 - protein, 114 aa, Artificial Sequence
  Synthetic polypeptide.
MRLLILALLGICSLTAYIVEGVGSEVSDKRTCVSLTTQRLPVSRIKTYTITEGSLRAVIFITKRGLKVCADPQATWVRDVVRSMDRKSNTRNNMIQTKPTGTQQSTNTAVTLTG

SEQ ID NO: 1457 - protein, 4 aa, Artificial Sequence
  Synthetic polypeptide.
CPPC

SEQ ID NO: 1458 - protein, 9 aa, Artificial Sequence
  Synthetic polypeptide.
DKTHTCPPC

SEQ ID NO: 1459 - protein, 14 aa, Artificial Sequence
  Synthetic polypeptide.
EPKSCDKTHTCPPC

SEQ ID NO: 1460 - protein, 14 aa, Artificial Sequence
  Synthetic polypeptide.
EPKSSDKTHTCPPC

SEQ ID NO: 1461 - protein, 227 aa, Artificial Sequence
  Synthetic polypeptide.
DKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLTSKLTVDKSRWQQGNVFSCSVMHEALHNHYTQKSLSLSPGK

SEQ ID NO: 1462 - protein, 227 aa, Artificial Sequence
  Synthetic polypeptide.
DKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLYCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1463 - protein, 227 aa, Artificial Sequence
  Synthetic polypeptide.
DKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 1464 - protein, 227 aa, Artificial Sequence
  Synthetic polypeptide.
DKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1465 - protein, 414 aa, Artificial Sequence
  Synthetic polypeptide
QVQLQESGGGSVQAGDSLRLSCAASGRTFSGYAMGWFRQAPGKEREFVATISTSGSSTYYADSVKGRFTISRDNAKKSVYLQINSLKTEDAAVYYCAARLSFDNTAFYTSAIRYSYWGQGTQVTVSSGGSGGSGGSGGSGGSGGSGGSGGSGGSGGSGGSGGSGGSGGSGGSGGSGGSGGSGGSGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCQVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 1466 - protein, 452 aa, Artificial Sequence
  Synthetic polypeptide
DKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCQVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGKGGSGGSGGSGGSGGSGGSGGSGGSGGSGGSGGSGGSGGSGGSGGSGGSGGSGGSGGSGGSCDLPQTHSLGSRRTLMLLAQMRKISLFSCLKDRHDFGFPQEEFGNQFQKAETIPVLHEMIQQIFNLFSTKDSSAAWDETLLDKFYTELYQQLNDLEACVIQGVGVEETPLMKEDSILAVRKYFQRITLYLKEKKYSPCAWEVVRAEIMASFSLSTNLQESLRSKE

SEQ ID NO: 1467 - protein, 414 aa, Artificial Sequence; identical to SEQ ID NO: 1465
  Synthetic polypeptide

SEQ ID NO: 1468 - protein, 411 aa, Artificial Sequence
  Synthetic polypeptide
QVQLQESGGGLVHPGGSLRLSCAASGRSFSSYFMGWFRQAPGKEREFVAGIGWNDGSINYADSVKGRFTISRDNAKNTGYLQMNSLKPEDTAVYYCAASVSLYGLEKSSAYTSWGQGTQVTVSSGGSGGSGGSGGSGGSGGSGGSGGSGGSGGSGGSGGSGGSGGSGGSGGSGGSGGSGGSGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCQVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 1469 - protein, 452 aa, Artificial Sequence; identical to SEQ ID NO: 1466
  Synthetic polypeptide

SEQ ID NO: 1470 - protein, 632 aa, Artificial Sequence
  Synthetic polypeptide
QVQLQESGGGLVQPGGSLRLSCAASGSIFSINVMGWYRQTPGKERELVAKITNFGITSYADSAQGRFTISRGNAKNTVYLQMNSLKPEDTAVYYCNLDTTGWGPPPYQYWGQGTQVTVSSGGSGGSGGSGGSGGSGGSGGSGGSGGSGGSGGSGGSGGSGGSGGSGGSGGSGGSGGSGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCQVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGKGGSGGSGGSGGSGGSGGSGGSGGSGGSGGSGGSGGSGGSGGSGGSGGSGGSGGSGGSGGSCDLPQTHSLGSRRTLMLLAQMRKISLFSCLKDRHDFGFPQEEFGNQFQKAETIPVLHEMIQQIFNLFSTKDSSAAWDETLLDKFYTELYQQLNDLEACVIQGVGVEETPLMKEDSILAVRKYFQRITLYLKEKKYSPCAWEVVRAEIMASFSLSTNLQESLRSKE

SEQ ID NO: 1471 - protein, 414 aa, Artificial Sequence; identical to SEQ ID NO: 1465
  Synthetic polypeptide

SEQ ID NO: 1472 - protein, 452 aa, Artificial Sequence; identical to SEQ ID NO: 1466
  Synthetic polypeptide

SEQ ID NO: 1473 - protein, 452 aa, Artificial Sequence
  Synthetic polypeptide
DKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCQVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGKGGSGGSGGSGGSGGSGGSGGSGGSGGSGGSGGSGGSGGSGGSGGSGGSGGSGGSGGSGGSCDLPQTHSLGSRRTLMLLAQMRKISLFSCLKDRHDFGFPQEEFGNQFQKAETIPVLHEMIQQIFNLFSTKDSSAAWDETLLDKFYTELYQQLNDLEACVIQGVGVEETPLMKEDSILAVRKYFQRITLYLKEKKYSPCAWEVVRAEIMRSFSLSTNLQESLRSKE

What is claimed is:

1. A chimeric protein comprising:
   (a) a targeting moiety comprising a recognition domain which recognizes and binds to C-Type Lectin Domain Family 4 Member C (Clec4C), wherein the recognition domain comprises a single-domain antibody comprising three complementarity determining regions (CDR1, CDR2, and CDR3), wherein:
      (i) CDR1 comprises an amino acid sequence selected from any one of SEQ ID NOs: 1237, 1227-1236 and 1238-1288;
      (ii) CDR2 comprises an amino acid sequence selected from any one of SEQ ID NO: 1300, 1289-1299 and 1301-1365; and
      (iii) CDR3 comprises an amino acid sequence selected from any one of SEQ ID NO: 1375, 1366-1374, and 1376-1399; and
   (b) a modified human IFN-α2, said modified human IFN-α2 having one or more mutations that confer improved safety as compared to a wild type human IFN-α2, and
   wherein the targeting moiety and modified human IFN-α2 are connected with one or more linkers.

2. The chimeric protein of claim 1, further comprising one or more additional targeting moieties.

3. The chimeric protein of claim 2, wherein the one or more additional targeting moieties comprise a recognition domain that recognizes and binds an antigen or receptor on a tumor cell, an immune cell, or a cell, tissue, or organ affected by autoimmune disease.

4. The chimeric protein of claim 2, wherein the one or more additional targeting moieties recognize and bind one or more of CD8, Clec9A and X-C Chemokine Receptor 1 (XCR1).

5. The chimeric protein of claim 4, wherein the one or more additional targeting moieties that recognize and bind XCR1 is X-C Chemokine Ligand 1 (XCL1) or X-C Chemokine Ligand 2 (XCL2).

6. The chimeric protein of claim 1, wherein the single-domain antibody comprises a recombinant heavy-chain-only antibody (VHH) or a shark heavy-chain-only antibody (VNAR).

7. The chimeric protein of claim 6, wherein the recognition domain comprises a VHH.

8. The chimeric protein of claim 1, wherein the modified human IFN-α2 comprises one or more mutations conferring reduced affinity or activity for a receptor relative to a wild type human IFN-α2.

9. The chimeric protein of claim 8, wherein the one or more mutations allow for attenuation of activity.

10. The chimeric protein of claim 8, wherein the mutation confers reduced affinity or activity that is restorable by attachment to one or more targeting moiety.

11. The chimeric protein of claim 1, wherein the modified human IFN-α2 comprises one or more mutations at positions selected from R149, R33, R144, A145, L153, and M148 with reference to SEQ ID NO: 46 or SEQ ID NO: 47.

12. The chimeric protein of claim 1, wherein the targeting moiety comprises one or more of:
   a CDR1 comprising the amino acid sequence of SEQ ID NO: 1227 or 1264, a CDR2 comprising the amino acid sequence of SEQ ID NO: 1289 or 1326, and a CDR3 comprising the amino acid sequence of SEQ ID NO: 1366;
   CDR1 comprising the amino acid sequence of SEQ ID NO: 1227 or 1264, a CDR2 comprising the amino acid sequence of SEQ ID NO: 1290 or 1327, and a CDR3 comprising the amino acid sequence of SEQ ID NO: 1367;
   CDR1 comprising the amino acid sequence of SEQ ID NO: 1227 or 1264, a CDR2 comprising the amino acid sequence of SEQ ID NO: 1291 or 1328, and a CDR3 comprising the amino acid sequence of SEQ ID NO: 1366;
   CDR1 comprising the amino acid sequence of SEQ ID NO: 1227 or 1264, a CDR2 comprising the amino acid sequence of SEQ ID NO: 1290 or 1327, and a CDR3 comprising the amino acid sequence of SEQ ID NO: 1367;
   CDR1 comprising the amino acid sequence of SEQ ID NO: 1227 or 1264, a CDR2 comprising the amino acid sequence of SEQ ID NO: 1289 or 1326, and a CDR3 comprising the amino acid sequence of SEQ ID NO: 1366;
   CDR1 comprising the amino acid sequence of SEQ ID NO: 1228 or 1265, a CDR2 comprising the amino acid sequence of SEQ ID NO: 1289 or 1326, and a CDR3 comprising the amino acid sequence of SEQ ID NO: 1366;
   CDR1 comprising the amino acid sequence of SEQ ID NO: 1227 or 1264, a CDR2 comprising the amino acid sequence of SEQ ID NO: 1290 or 1327, and a CDR3 comprising the amino acid sequence of SEQ ID NO: 1367;
   CDR1 comprising the amino acid sequence of SEQ ID NO: 1227 or 1264, a CDR2 comprising the amino acid sequence of SEQ ID NO: 1290 or 1329, and a CDR3 comprising the amino acid sequence of SEQ ID NO: 1367;
   CDR1 comprising the amino acid sequence of SEQ ID NO: 1229 or 1264, a CDR2 comprising the amino acid sequence of SEQ ID NO: 1290 or 1330, and a CDR3 comprising the amino acid sequence of SEQ ID NO: 1367;
   CDR1 comprising the amino acid sequence of SEQ ID NO: 1230 or 1266, a CDR2 comprising the amino acid sequence of SEQ ID NO: 1292 or 1331, and a CDR3 comprising the amino acid sequence of SEQ ID NO: 1368;

CDR1 comprising the amino acid sequence of SEQ ID NO: 1230 or 1266, a CDR2 comprising the amino acid sequence of SEQ ID NO: 1292 or 1332, and a CDR3 comprising the amino acid sequence of SEQ ID NO: 1368;

CDR1 comprising the amino acid sequence of SEQ ID NO: 1231 or 1267, a CDR2 comprising the amino acid sequence of SEQ ID NO: 1293 or 1333, and a CDR3 comprising the amino acid sequence of SEQ ID NO: 1369;

CDR1 comprising the amino acid sequence of SEQ ID NO: 1232 or 1268, a CDR2 comprising the amino acid sequence of SEQ ID NO: 1294 or 1334, and a CDR3 comprising the amino acid sequence of SEQ ID NO: 1369;

CDR1 comprising the amino acid sequence of SEQ ID NO: 1231 or 1267, a CDR2 comprising the amino acid sequence of SEQ ID NO: 1295 or 1335, and a CDR3 comprising the amino acid sequence of SEQ ID NO: 1370;

CDR1 comprising the amino acid sequence of SEQ ID NO: 1233 or 1267, a CDR2 comprising the amino acid sequence of SEQ ID NO: 1294 or 1334, and a CDR3 comprising the amino acid sequence of SEQ ID NO: 1371;

CDR1 comprising the amino acid sequence of SEQ ID NO: 1234 or 1269, a CDR2 comprising the amino acid sequence of SEQ ID NO: 1296 or 1336, and a CDR3 comprising the amino acid sequence of SEQ ID NO: 1372;

CDR1 comprising the amino acid sequence of SEQ ID NO: 1234 or 1269, a CDR2 comprising the amino acid sequence of SEQ ID NO: 1297 or 1337, and a CDR3 comprising the amino acid sequence of SEQ ID NO: 1372;

CDR1 comprising the amino acid sequence of SEQ ID NO: 1235 or 1270, a CDR2 comprising the amino acid sequence of SEQ ID NO: 1298 or 1338, and a CDR3 comprising the amino acid sequence of SEQ ID NO: 1373;

CDR1 comprising the amino acid sequence of SEQ ID NO: 1236 or 1271, a CDR2 comprising the amino acid sequence of SEQ ID NO: 1299 or 1339, and a CDR3 comprising the amino acid sequence of SEQ ID NO: 1374;

CDR1 comprising the amino acid sequence of SEQ ID NO: 1237 or 1272, a CDR2 comprising the amino acid sequence of SEQ ID NO: 1300 or 1340, and a CDR3 comprising the amino acid sequence of SEQ ID NO: 1375;

CDR1 comprising the amino acid sequence of SEQ ID NO: 1238 or 1272, a CDR2 comprising the amino acid sequence of SEQ ID NO: 1301 or 1341, and a CDR3 comprising the amino acid sequence of SEQ ID NO: 1376;

CDR1 comprising the amino acid sequence of SEQ ID NO: 1236 or 1271, a CDR2 comprising the amino acid sequence of SEQ ID NO: 1302 or 1342, and a CDR3 comprising the amino acid sequence of SEQ ID NO: 1376;

CDR1 comprising the amino acid sequence of SEQ ID NO: 1239 or 1273, a CDR2 comprising the amino acid sequence of SEQ ID NO: 1303 or 1343, and a CDR3 comprising the amino acid sequence of SEQ ID NO: 1377;

CDR1 comprising the amino acid sequence of SEQ ID NO: 1239 or 1273, a CDR2 comprising the amino acid sequence of SEQ ID NO: 1304 or 1344, and a CDR3 comprising the amino acid sequence of SEQ ID NO: 1378;

CDR1 comprising the amino acid sequence of SEQ ID NO: 1240 or 1274, a CDR2 comprising the amino acid sequence of SEQ ID NO: 1304 or 1344, and a CDR3 comprising the amino acid sequence of SEQ ID NO: 1378;

CDR1 comprising the amino acid sequence of SEQ ID NO: 1241 or 1275, a CDR2 comprising the amino acid sequence of SEQ ID NO: 1305 or 1345, and a CDR3 comprising the amino acid sequence of SEQ ID NO: 1379;

CDR1 comprising the amino acid sequence of SEQ ID NO: 1242 or 1275, a CDR2 comprising the amino acid sequence of SEQ ID NO: 1305 or 1345, and a CDR3 comprising the amino acid sequence of SEQ ID NO: 1379;

CDR1 comprising the amino acid sequence of SEQ ID NO: 1243 or 1270, a CDR2 comprising the amino acid sequence of SEQ ID NO: 1306 or 1346, and a CDR3 comprising the amino acid sequence of SEQ ID NO: 1380;

CDR1 comprising the amino acid sequence of SEQ ID NO: 1235 or 1270, a CDR2 comprising the amino acid sequence of SEQ ID NO: 1307 or 1347, and a CDR3 comprising the amino acid sequence of SEQ ID NO: 1381;

CDR1 comprising the amino acid sequence of SEQ ID NO: 1245 or 1270, a CDR2 comprising the amino acid sequence of SEQ ID NO: 1308 or 1348, and a CDR3 comprising the amino acid sequence of SEQ ID NO: 1382;

CDR1 comprising the amino acid sequence of SEQ ID NO: 1246 or 1270, a CDR2 comprising the amino acid sequence of SEQ ID NO: 1309 or 1349, and a CDR3 comprising the amino acid sequence of SEQ ID NO: 1383;

CDR1 comprising the amino acid sequence of SEQ ID NO: 1247 or 1276, a CDR2 comprising the amino acid sequence of SEQ ID NO: 1310 or 1350, and a CDR3 comprising the amino acid sequence of SEQ ID NO: 1384;

CDR1 comprising the amino acid sequence of SEQ ID NO: 1248 or 1277, a CDR2 comprising the amino acid sequence of SEQ ID NO: 1311 or 1351, and a CDR3 comprising the amino acid sequence of SEQ ID NO: 1385;

CDR1 comprising the amino acid sequence of SEQ ID NO: 1249 or 1278, a CDR2 comprising the amino acid sequence of SEQ ID NO: 1312 or 1352, and a CDR3 comprising the amino acid sequence of SEQ ID NO: 1386;

CDR1 comprising the amino acid sequence of SEQ ID NO: 1250 or 1279, a CDR2 comprising the amino acid sequence of SEQ ID NO: 1313 or 1353, and a CDR3 comprising the amino acid sequence of SEQ ID NO: 1387;

CDR1 comprising the amino acid sequence of SEQ ID NO: 1251 or 1280, a CDR2 comprising the amino acid sequence of SEQ ID NO: 1314 or 1354, and a CDR3 comprising the amino acid sequence of SEQ ID NO: 1388;
CDR1 comprising the amino acid sequence of SEQ ID NO: 1252 or 1281, a CDR2 comprising the amino acid sequence of SEQ ID NO: 1315 or 1355, and a CDR3 comprising the amino acid sequence of SEQ ID NO: 1389;
CDR1 comprising the amino acid sequence of SEQ ID NO: 1253 or 1282, a CDR2 comprising the amino acid sequence of SEQ ID NO: 1316 or 1356, and a CDR3 comprising the amino acid sequence of SEQ ID NO: 1390;
CDR1 comprising the amino acid sequence of SEQ ID NO: 1254 or 1283, a CDR2 comprising the amino acid sequence of SEQ ID NO: 1317 or 1357, and a CDR3 comprising the amino acid sequence of SEQ ID NO: 1391;
CDR1 comprising the amino acid sequence of SEQ ID NO: 1255 or 1270, a CDR2 comprising the amino acid sequence of SEQ ID NO: 1318 or 1358, and a CDR3 comprising the amino acid sequence of SEQ ID NO: 1392;
CDR1 comprising the amino acid sequence of SEQ ID NO: 1256 or 1270, a CDR2 comprising the amino acid sequence of SEQ ID NO: 1319 or 1359, and a CDR3 comprising the amino acid sequence of SEQ ID NO: 1393;
CDR1 comprising the amino acid sequence of SEQ ID NO: 1253 or 1282, a CDR2 comprising the amino acid sequence of SEQ ID NO: 1320 or 1360, and a CDR3 comprising the amino acid sequence of SEQ ID NO: 1394;
CDR1 comprising the amino acid sequence of SEQ ID NO: 1257 or 1284, a CDR2 comprising the amino acid sequence of SEQ ID NO: 1321 or 1361, and a CDR3 comprising the amino acid sequence of SEQ ID NO: 1395;
CDR1 comprising the amino acid sequence of SEQ ID NO: 1258 or 1285, a CDR2 comprising the amino acid sequence of SEQ ID NO: 1322 or 1362, and a CDR3 comprising the amino acid sequence of SEQ ID NO: 1396;
CDR1 comprising the amino acid sequence of SEQ ID NO: 1231 or 1267, a CDR2 comprising the amino acid sequence of SEQ ID NO: 1323 or 1363, and a CDR3 comprising the amino acid sequence of SEQ ID NO: 1397;
CDR1 comprising the amino acid sequence of SEQ ID NO: 1259 or 1286, a CDR2 comprising the amino acid sequence of SEQ ID NO: 1324 or 1364, and a CDR3 comprising the amino acid sequence of SEQ ID NO: 1398;
CDR1 comprising the amino acid sequence of SEQ ID NO: 1260 or 1287, a CDR2 comprising the amino acid sequence of SEQ ID NO: 1325 or 1365, and a CDR3 comprising the amino acid sequence of SEQ ID NO: 1399;
CDR1 comprising the amino acid sequence of SEQ ID NO: 1227 or 1264, a CDR2 comprising the amino acid sequence of SEQ ID NO: 1290 or 1327, and a CDR3 comprising the amino acid sequence of SEQ ID NO: 1367;
CDR1 comprising the amino acid sequence of SEQ ID NO: 1235 or 1270, a CDR2 comprising the amino acid sequence of SEQ ID NO: 1298 or 1338, and a CDR3 comprising the amino acid sequence of SEQ ID NO: 1373;
CDR1 comprising the amino acid sequence of SEQ ID NO: 1231 or 1267, a CDR2 comprising the amino acid sequence of SEQ ID NO: 1323 or 1363, and a CDR3 comprising the amino acid sequence of SEQ ID NO: 1397; and
CDR1 comprising the amino acid sequence of SEQ ID NO: 1260 or 1287, a CDR2 comprising the amino acid sequence of SEQ ID NO: 1325 or 1365, and a CDR3 comprising the amino acid sequence of SEQ ID NO: 1399.

13. The chimeric protein of claim 12, wherein the targeting moiety comprises an amino acid sequence having at least 95% similarity with any one of SEQ ID NOs: 1424, 1400-1423 and 1425-1455.

14. A recombinant nucleic acid encoding the chimeric protein of claim 1.

15. A host cell comprising the nucleic acid of claim 14.

16. A method for treating cancer, comprising administering to a patient in need thereof an effective amount of the chimeric protein of claim 1.

17. A method for treating an autoimmune disease, comprising administering to a patient in need thereof an effective amount of the chimeric protein of claim 1.

* * * * *